US011213586B2

(12) United States Patent
Wang et al.

(10) Patent No.: US 11,213,586 B2
(45) Date of Patent: Jan. 4, 2022

(54) ANTIBODIES AGAINST GLUCOCORTICOID-INDUCED TUMOR NECROSIS FACTOR RECEPTOR (GITR)

(71) Applicant: BRISTOL-MYERS SQUIBB COMPANY, Princeton, NJ (US)

(72) Inventors: Changyu Wang, Union City, CA (US); Nils Lonberg, Woodside, CA (US); Alan J. Korman, Piedmont, CA (US); Mark J. Selby, San Francisco, CA (US); Mohan Srinivasan, Cupertino, CA (US); Karla A. Henning, Milpitas, CA (US); Michelle Minhua Han, Piedmont, CA (US); Guodong Chen, East Brunswick, NJ (US); Richard Y. Huang, Bridgewater, NJ (US); Indrani Chakraborty, Fremont, CA (US); Haichun Huang, Fremont, CA (US); Susan Chien-Szu Wong, Fremont, CA (US); Huiming Li, Lexington, MA (US); Bryan C. Barnhart, San Francisco, CA (US); Aaron P. Yamniuk, Lawrenceville, NJ (US); Ming Lei, Princeton, NJ (US); Liang Schweizer, Shanghai (CN); Sandra V. Hatcher, Hillsborough, NJ (US); Arvind Rajpal, San Francisco, CA (US)

(73) Assignee: BRISTOL-MYERS SQUIBB COMPANY, Princeton, NJ (US)

( * ) Notice: Subject to any disclaimer, the term of this patent is extended or adjusted under 35 U.S.C. 154(b) by 213 days.

(21) Appl. No.: 15/776,591

(22) PCT Filed: Nov. 17, 2016

(86) PCT No.: PCT/US2016/062540
§ 371 (c)(1),
(2) Date: May 16, 2018

(87) PCT Pub. No.: WO2017/087678
PCT Pub. Date: May 26, 2017

(65) Prior Publication Data
US 2018/0339042 A1    Nov. 29, 2018

Related U.S. Application Data

(60) Provisional application No. 62/303,990, filed on Mar. 4, 2016, provisional application No. 62/257,599, filed on Nov. 19, 2015.

(51) Int. Cl.
*C07K 16/28* (2006.01)
*A61K 39/395* (2006.01)
*G01N 33/574* (2006.01)
*G01N 33/68* (2006.01)
*A61K 39/00* (2006.01)

(52) U.S. Cl.
CPC .... *A61K 39/39558* (2013.01); *C07K 16/2818* (2013.01); *C07K 16/2878* (2013.01); *G01N 33/574* (2013.01); *G01N 33/6863* (2013.01); *A61K 2039/507* (2013.01); *A61K 2039/572* (2013.01); *C07K 2317/21* (2013.01); *C07K 2317/34* (2013.01); *C07K 2317/732* (2013.01); *C07K 2317/75* (2013.01); *C07K 2317/77* (2013.01); *C07K 2317/92* (2013.01)

(58) Field of Classification Search
None
See application file for complete search history.

(56) References Cited

U.S. PATENT DOCUMENTS

| | | |
|---|---|---|
| 5,624,821 A | 4/1997 | Winter et al. |
| 5,648,260 A | 7/1997 | Winter et al. |
| 6,111,090 A | 8/2000 | Gorman et al. |
| 6,509,173 B1 | 1/2003 | Ni et al. |
| 7,025,962 B1 | 4/2006 | Gorman et al. |
| 7,247,302 B1 | 7/2007 | Rosok et al. |
| 7,812,135 B2 | 10/2010 | Smith et al. |
| 8,709,424 B2 | 4/2014 | Schebye et al. |
| 9,228,016 B2 | 1/2016 | Wang et al. |
| 9,745,379 B2 | 8/2017 | Wang et al. |

(Continued)

FOREIGN PATENT DOCUMENTS

| | | |
|---|---|---|
| EP | 0920505 B1 | 6/2008 |
| EP | 2343320 A1 | 7/2011 |

(Continued)

OTHER PUBLICATIONS

Rudikoff et al Proc NatlAcad Sci USA 79: 1979, 1982 (Year: 1982).*

(Continued)

*Primary Examiner* — Michael D Pak

(74) *Attorney, Agent, or Firm* — Nelson Mullins Riley & Scarborough LLP; Jane E. Remillard, Esq.; Christopher L. Frank

(57) ABSTRACT

Provided herein are antibodies, or antigen binding portions thereof, that bind to glucocorticoid-inducible TNF receptor (GITR). Also provided are uses of these proteins in therapeutic applications, such as in the treatment of cancer. Further provided are cells that produce the antibodies, polynucleotides encoding the heavy and/or light chain variable region of the antibodies, and vectors comprising the polynucleotides encoding the heavy and/or light chain variable region of the antibodies.

14 Claims, 113 Drawing Sheets
Specification includes a Sequence Listing.

(56) References Cited

U.S. PATENT DOCUMENTS

| | | |
|---|---|---|
| 10,465,010 B2 | 11/2019 | Wang et al. |
| 10,501,550 B2 | 12/2019 | Wang et al. |
| 2002/0081597 A1 | 6/2002 | Lowe et al. |
| 2006/0099171 A1 | 5/2006 | Tone et al. |
| 2006/0281146 A1 | 12/2006 | Bodary et al. |
| 2006/0286112 A1 | 12/2006 | Kellermann et al. |
| 2007/0037148 A1 | 2/2007 | Fong et al. |
| 2007/0048301 A1 | 3/2007 | Bodary-Winter et al. |
| 2007/0185017 A1 | 8/2007 | Aggarwal et al. |
| 2012/0328616 A1 | 12/2012 | Li et al. |
| 2014/0065152 A1 | 3/2014 | Kwon |
| 2015/0064204 A1 | 3/2015 | Beers et al. |
| 2015/0353637 A1 | 12/2015 | Wang et al. |
| 2016/0145342 A1 | 5/2016 | Wang et al. |
| 2017/0145104 A1 | 5/2017 | Wang et al. |
| 2018/0002432 A1 | 1/2018 | Wang et al. |
| 2020/0079865 A1 | 3/2020 | Wang et al. |
| 2020/0115463 A1 | 4/2020 | Wang et al. |

FOREIGN PATENT DOCUMENTS

| | | |
|---|---|---|
| EP | 2481752 A1 | 8/2012 |
| JP | 2008 278814 A | 11/2008 |
| KR | 20080105674 A | 12/2008 |
| WO | 98/06842 A1 | 2/1998 |
| WO | 98/24895 A1 | 6/1998 |
| WO | 99/20758 A1 | 4/1999 |
| WO | 99/25834 A1 | 5/1999 |
| WO | 99/40196 A1 | 8/1999 |
| WO | 00/05374 A2 | 2/2000 |
| WO | 00/32221 A2 | 6/2000 |
| WO | 00/32778 A2 | 6/2000 |
| WO | 00/50459 A1 | 8/2000 |
| WO | 2001003720 A2 | 1/2001 |
| WO | 2001/46232 A2 | 6/2001 |
| WO | 2001/46261 A1 | 6/2001 |
| WO | 2001040464 A1 | 6/2001 |
| WO | 2001/90304 A2 | 11/2001 |
| WO | 2002/22153 A2 | 3/2002 |
| WO | 2002/072607 A2 | 9/2002 |
| WO | 2003/006058 A1 | 1/2003 |
| WO | 2003068257 A1 | 8/2003 |
| WO | 2004/107618 A2 | 12/2004 |
| WO | 2005/007190 A1 | 1/2005 |
| WO | 2005/007699 A2 | 1/2005 |
| WO | 2005/016962 A2 | 2/2005 |
| WO | 2005/019258 A2 | 3/2005 |
| WO | 2005/052000 A2 | 6/2005 |
| WO | 2005/052001 A2 | 6/2005 |
| WO | 2005/100402 A1 | 10/2005 |
| WO | 2006050172 A2 | 5/2006 |
| WO | 2006078911 A2 | 7/2006 |
| WO | 2006/105021 A2 | 10/2006 |
| WO | 2006/124269 A2 | 11/2006 |
| WO | 2006/132272 A1 | 12/2006 |
| WO | 2007/002223 A2 | 1/2007 |
| WO | 2007120368 A2 | 10/2007 |
| WO | 2007/133822 A1 | 11/2007 |
| WO | 2008/070593 A2 | 6/2008 |
| WO | 2009/009116 A2 | 1/2009 |
| WO | 2009/100309 A2 | 8/2009 |
| WO | 2009/120922 A2 | 10/2009 |
| WO | 2011/028683 A1 | 3/2011 |
| WO | 2011109789 A2 | 9/2011 |
| WO | 2011/120134 A1 | 10/2011 |
| WO | 2012/016227 A2 | 2/2012 |
| WO | 2012087928 A2 | 6/2012 |
| WO | 2012/098113 A1 | 7/2012 |
| WO | 2013/039954 A1 | 3/2013 |
| WO | 2013/043569 A1 | 3/2013 |
| WO | 2013/177101 A2 | 11/2013 |
| WO | 2014/089113 A1 | 6/2014 |
| WO | 2015/026684 A1 | 2/2015 |
| WO | 2015/031667 A2 | 3/2015 |
| WO | 2015/145360 A1 | 10/2015 |
| WO | 2015/184099 A1 | 12/2015 |
| WO | 2015/187835 A2 | 12/2015 |
| WO | 2016054638 A1 | 4/2016 |
| WO | 2016/196792 A1 | 12/2016 |

OTHER PUBLICATIONS

Barrios et al J Molecular Recognition 17: 332-338, 2004 (Year: 2004).*
Piatesi et al. ChemBio Chem 5: 460-466, 2004 (Year: 2004).*
U.S. Appl. No. 16/578,987, filed Sep. 23, 2019, Changyu Wang.
U.S. Appl. No. 16/663,583, filed Oct. 25, 2019, Changyu Wang.
U.S. Appl. No. 15/646,558, filed Jun. 21, 2019, S. Shafer.
U.S. Appl. No. 15/646,558, filed Feb. 4, 2019, S. Shafer.
U.S. Appl. No. 15/369,290, filed Oct. 24, 2019, J. Roark.
U.S. Appl. No. 15/369,290, filed Jul. 25, 2019, J. Roark.
U.S. Appl. No. 15/369,290, filed Nov. 8, 2018, J. Roark.
Reichert, J. et al., "Monoclonal antibodies in the clinic," Nat. Biotech, vol. 19, 819-822 (2001).
Ronchetti et al., "GITR, a member of the TNF receptor superfamily, is costimulatory to mouse T lymphocyte subpopulations," Eur J Immunol, vol. 34, 613-622 (2004).
Rosenzweig et al., "Development of TRX518, an aglycosyl humanized monoclonal antibody (Mab) agonist of nuGITR.," ASCO Meeting Library 2010 Annual Meeting, 1-2.
Safety Study of AMG 228 to Treat Solid Tumors, ClinicalTrials.gov Identifier: NCT02437916, date first posted: May 8, 2015, date last updated: Feb. 6, 2017,date retrieved: Feb. 14, 2018, 7 pages, <https://clinicaltrials.gov/show/NCT02437916>.
Schaer et al., "Anti-GITR antibodies—Potential Clinical applications for tumor immunotherapy," Curr Opin in Investigational Drugs, vol. 11 (12), 1378-1386 (2010).
Schaer, et al. "Modulation of GITR for cancer immunotherapy," Curr Opin in Immunol, vol. 24, 217-224 (2012).
Shimizu et al., "Stimulation of CD25+CD4+ regulatory T cells through GITR breaks immunological self-tolerance," Nature Immunol, vol. 3 (2), 135-142 (2002).
Siu, L. et al., "Preliminary results of a phase I/IIa study of BMS-986156 (glucocorticoid-induced tumor necrosis factor receptor-related gene [GITR] agonist), alone and in combination with nivolumab in pts with advanced solid tumors," Journal of Clinical Oncology, vol. 35 (15):Supp. 104: (May 2017) 4 page, retrieved date: Feb. 14, 2018, <http://ascopubs.org/doi/abs/10.1200/JCO.2017.35.15_suppl.104>.
Siu, L. et al., Preliminary Results of a Phase 1/2a Study of BMS-986156 (glucocorticoid-induced tumor necrosis factor receptor-related gene [GITR] agonist) Alone and in Combination With Nivolumab in Patients With Advanced Solid Tumors, slides presented at the ASCO Annual Meeting 2017, Jun. 2, 2017, 18 pages.
Study of MK-1248 With and Without Pembrolizumab (MK-3475) for Participants With Advanced Solid Tumors (MK-1248-001), ClinicalTrials.gov Identifier: NCT02553499, date first posted: Sep. 17, 2015 date last updated: Feb. 2, 2018, date retrieved: Feb. 14, 2018, 6 pages <https://clinicaltrials.gov/show/NCT02553499>.
Study of MK-4166 and MK-4166 in Combination With Pembrolizumab (MK-3475) in Participants With Advanced Solid Tumors (MK-4166-001), ClinicalTrials.gov Identifier: NCT02132754, date first posted: May 7, 2014, date last updated Jan. 25, 2018, date retrieved: Feb. 14, 2018, 7 pages <https://clinicaltrials.gov/ct2/show/NCT02132754?term=mk4166&rank=1 >.
Turk, et al., "Concomitant Tumor Immunity to a Poorly Immunogenic Melanoma Is Prevented by Regulatory T Cells," Journal of Exp Medicine, vol. 200 (6) 771-782 (2004).
U.S. Appl. No. 60/665,322, filed Mar. 25, 2005, 62 pages.
U.S. Appl. No. 60/687,265, filed Jun. 3, 2005, 71 pages.
Wang, H. et al., "Integration of Nonclinical PK/PD Data for First-in-Human Starting Dose Selection of Cancer Immune therapeutics," presented on Oct. 18, 2017 at 2017 (ISoP) International Society of Pharmacometrics—8th American Conference on Pharmacometrics (ACoP 8), 17 pages.
Website Information for human GITR/TNFRSF 18 MAb (Clone 110416), Catalog No. MAB589, 1-2.

(56) References Cited

OTHER PUBLICATIONS

White, A. et al., "Conformation of the Human Immunoglobulin G2 Hinge Imparts Superagonistic Properties to Immunostimulatory Anticancer Antibodies," Cancer Cell, vol. 27(1):138-148 (2015).
Whiteside, S. et al., "IkB proteins: structure, function and regulation," Seminars in Cancer Biology, vol. 8, 75-82 (1997).
Yang, W. et al., "CDR Walking Mutagenesis for the Affinity Maturation of a Potent Human Anti-HIV-1 Antibody into the Picomolar Range," J. Mol. Biol., vol. 254 (3): 392-403 (1995).
U.S. Appl. No. 16/133,418, filed Sep. 17, 2018, Suba Krishnan.
U.S. Appl. No. 15/264,266, filed Sep. 13, 2016, Suba Krishnan.
U.S. Appl. No. 15/369,290, filed Dec. 5, 2016, Changyu Wang.
U.S. Appl. No. 15/646,558, filed Jul. 11, 2017, Changyu Wang.
U.S. Appl. No. 14/949,424, filed Nov. 23, 2015, Changyu Wang.
U.S. Appl. No. 14/732,082, filed Jun. 5, 2015, Changyu Wang.
U.S. Appl. No. 15/369,290, filed Jul. 16, 2018, J. Roark.
U.S. Appl. No. 15/369,290, filed Feb. 8, 2018, J. Roark.
U.S. Appl. No. 15/646,558, filed Sep. 26, 2018, S. Shafer.
U.S. Appl. No. 15/646,558, filed May 30, 2018, S. Shafer.
U.S. Appl. No. 14/949,424, filed Apr. 20, 2017, S. Shafer.
U.S. Appl. No. 14/949,424, filed Apr. 13, 2017, S. Shafer.
U.S. Appl. No. 14/949,424, filed Jan. 25, 2017, S. Shafer.
U.S. Appl. No. 14/949,424, filed Nov. 4, 2016, S. Shafer.
U.S. Appl. No. 14/732,082, filed Aug. 24, 2015, S. Shafer.
U.S. Appl. No. 14/732,082, filed Jul. 13, 2015, S. Shafer.
An Investigational Immuno-therapy Study of Experimental Medication BMS-986156, Given by Itself or in Combination With Nivolumab in Patients With Solid Cancers or Cancers That Have Spread, ClinicalTrials.gov Identifier NCT02598960, date first posted: Nov. 6, 2015, dated last updated: Feb. 1, 2018, 7 pages, date retrieved: Feb. 14, 2018 <https://clinicaltrials.gov/ct2/show/NCT02598960?term=BMS-986156&rank=1>.
Arnett, S. et al., "IBC's 21st Annual Antibody Engineering and 8th Annual Antibody Therapeutics International Conferences and 2010 Annual Meeting of The Antibody Society," Dec. 5-9, 2010, San Diego, CA USA, mAbs, vol. 3 (2), Mar./Apr. 2011, 133-152.
Avogadri, F. et al., "Modulation of CTLA- 4 and GITR for Cancer Immunotherapy," Curr Top Microbiol Immunol, vol. 344:211-244(2011).
Baecher-Allan, B. et al., "Inhibition of Human CD4+CD25+ high Regulatory T Cell Function," J. Immunol., vol. 169: 6210-6217 (2002).
Balint, R. et al., "Antibody Engineering by Parsimonious Mutagenesis," Gene, vol. 137:109-118 (1993).
Birebent, B. et al., "Suppressive properties of human CD4+CD25+ regulatory T cells are dependent on CTLA-4 expression," Eur. J. Immunol., vol. 34:3485-3496 (2004).
Bulliard, et al., "Activating Fc γ receptors contribute to the antitumor activities of immunoregulatory receptor-targeting antibodies," JEM, vol. 210 (9): 1685-1693 (2013).
Bulliard, et al., "Activating Fc γ receptors contribute to the antitumor activities of immunoregulatory receptor-targeting antibodies," Novartis Institutes for Biomedical Research and Dana Farber Cancer Institutes USA, No date, 1-3.
Carter et al., "Humanization of an anti-p185HER2 antibody for human cancer therapy," PNAS, vol. 89, 4285-4289 (1992).
Coe, D. et al., "Depletion of regulatory T cells by anti-GITR mAb as a novel mechanism for cancer immunotherapy," Cancer Immunol Immunother, vol. 59, 1367-1377 (2010).
Cohen et al., "Agonist Anti-GITR Monoclonal Antibody Induces Melanoma Tumor Immunity in Mice by Altering Regulatory T Cell Stability and Intra-Tumor Accumulation," PLoS, vol. 5, Iss. 5, 1-12 (2010).
Cohen et al., "Synergistic Tumor Immunity Induced by Chemotherapy and Agonist Anti-GITR Antibody," Blood, ASH Annual Meeting Abstracts, Dec. 8-11, 2007, vol. 110 (11), 1788.
Cohen, et al., "Agonist Anti-GITR Antibody Enhances Vaccine-Induced CD8+ T-Cell Responses and Tumor Immunity," Cancer Res., vol. 66: (9):4904-4912 (2006).
Davies et al., "Affinity improvement of single antibody VH domains: residues in all three hypervariable regions affect antigen bnding," Immunotechnology, vol. 2, 169-179 (1996).
Dittmer et al., "Functional impairment of CD8+ T cellls by regulatory T cells during persistent retroviral infection," Immunirty, vol. 20, 293-303 (2004).
Glaus et al., "In vivo SPECT/CT imaging of an anti-GITR antibody: A novel cancer immunotherapeutic," J Nucl Med., vol. 54 (Supplement 2):327 (2013).
Godrey et al., "Cord blood CD4+ CD25+-derived T regulatory cell lines express FoxP3 protein and manifest potent suppressor function," Blood, vol. 105 No. 2, 750-758 (2005).
Gross et al., "TACI-Ig Neutralizes Molecules Critical for B Cell Development and Autoimmune Disease: Impaired B Cell Maturation in Mice Lacking BLyS," Immunity, vol. 15:289-302 (2001).
Gurney et al., "Identification of a new member of the tumor necrosis factor family and its receptor, a human ortholog of mouse GITR," Current Biology, vol. 9 (4), 215-218 (1999).
Hawkins, R.E. et al., "Selection of Phage Antibodies by Binding Affinity Mimicking Affinity Maturation," J. Mol. Biol., vol. 226(3): 889-896 (1992).
Hiroyoshi Nishikawa, "Application of Modulators of Cancer Immunosuppression for Immunotherapy—GITR and CTLA-4," The Medical Frontline, vol. 64 (11): 100-105 (2009).
Holt, L. et al., "Domain antibodies: proteins for therapy,"Trends in Biotechnology, vol. 21 (11): 484-490 (2003).
Houot et al., "T-cell modulation combined with intratumoral CpG cures lymphoma in a mouse model without the need or chemotherapy," Blood, vol. 113 (15):3546-3552 (2009).
International Preliminary Reporton Patentability, PCT/US2015/033991, dated Dec. 6, 2016, 11 pages.
International Preliminary Report on Patentability, PCT/US2016/062540, dated May 22, 2018, 17 pages.
International Search Report and Written Opinion, PCT/US2015/033991, dated Dec. 8, 2015, pp. 17.
International Search Report and Written Opinion, PCT/US2016/062540, dated Jun. 26, 2017, 26 pages.
Invitation to Pay Additional Fees and, Where Applicable, Protest Fees, PCT/US2016/062540, dated May 3, 2017, 25 pages.
Kanamaru et al., "Costimulation via Glucocorticoid-Induced TNF Receptor in Both Conventional and CD25+ Regulatory CD4+ T Cells," The Journal of Immunology, 7306-7314 (2004).
Kim et al., "Fcγ receptors enable anticancer action of proapoptotic and immune-modulatory antibodies," J Exp Med., vol. 210 (9) 1647-1657 (2013).
Ko et al., "A Combination of Chemoimmunotherapies Can Efficiently Break Self-Tolerance and Induce Antitumor mmunity in a Tolerogenic Murine Tumor Model," Cancer Research, vol. 67 (15) 7477-7486 (2007).
Ko et al., "Treatment of advanced tumors with agonistic anti-GITR mAb and its effects on tumor-infiltrating Foxp3+ CD25+ CD4+ regulatory T cells," JEM, vol. 202 (7), 885-891 (2005).
Kuenen, B. et al., "A phase I pharmacologic study of necitumumab (IMC-11F8), a fully human IgG1 monoclonal antibody directed against EGFR in patients with advanced solid malignancies," Clin Cancer Res., vol. 16(6) 1915-1923 (2010).
Kwon et al., "Identification of a Novel Activation-inducible Protein of the Tumor Necrosis Factor Receptor Superfamily and Its Ligand," Journal of Biol Chem, vol. 274 (10) 6056-6061 (1999).
Little et al., "Of Mice and Men: hybridoma and recombinant antibodies," Immunology Today, vol. 21(8): 364-370 (2000).
Lu et al. "Combined PD-1 blockade and GITR triggering induce a potent antitumor immunity in murine cancer models and synergizes with chemotherapeutic drugs," Journal of Translational Medicine, vol. 12 (36), 1-11 (2014).
Marks, J. et al., "By-Passing Immunization: Building High Affinity Human Antibodies By Chain Shuffling," Biotechnology, vol. 10(7): 779-783 (1992).
McHugh et al., "CD4+CD25+ Immunoregulatory T Cells: Gene Expression Analysis Reveals a Functional Role for the Glucocorticoid-Induced TNF Receptor," Immunity, vol. 16, 311-323 (2002).

(56) References Cited

OTHER PUBLICATIONS

Melero et al., "Agonist Antibodies to TNFR Molecules That Costimulate T and NK Cells," Clinical Cancer Research, vol. 19 (5): 1044-1053, 1913 (2013).

Melero et al., "Clinical Development of Immunostimulatory Monoclonal Antibodies and Opportunities for Combination," Clinical Cancer Research, vol. 19(5), 997-1008 (2013).

Melero, I., "Immunological targets: Basic aspects," IL29, Annals of Oncology, vol. 22 (Supplement 3), 8 pages, (2011) doi:10.1093/annonc/mdr103.

Mitsui et al., "Two Distinct Mechanisms of Augmented Antitumor Activity by Modulation of Immunostimulatory/Inhibitory Signals," Clinical Cancer Res, vol. 16, 2781-2791(2010).

National Cancer Institute, Immunotherapy Agent workshop Jul. 12, 2007, 1-77.

Nocentini et al., "A new member of the tumor necrosis factor/nerve growth factor receptor family inhibits T cell receptor-induced apoptosis," PNAS, vol. 94, 6216-6221 (1997).

Nocentini et al., "GITR: a multifaceted regulator of immunity belonging to the tumor necrosis factor receptor superfamily," Eur J of Immunol, vol. 35 Iss 4, 1016-1022 (2005).

Nocentini et al., "Identification of three novel mRNA splice variants of GITR,"Cell Death and Differentiation, vol. 7, 408-410 (2000).

Patel, M. et al., "Agonist anti-GITR monoclonal antibody and stereotactic radiation induce immune-mediated survival advantage in murine intracranial glioma," Journal for ImmunoTherapy of Cancer, vol. 4(28):13 pages (2007).

Ponte et al., "Enhancement of humoral and cellular immunity with an antiglucocorticoid- induced tumour necrosis factor receptor monoclonal antibody," Immunology, vol. 130, 231-242 (2010).

Press Release, Tolerx Presents Preclinical Data on Novel T-cell Modulator, TRX518, for Antitumor Immune Response at Federation of Clinical Immunology Societies Scientific Meeting, Cambridge, MA, Jun. 25, 2015, PR Newswire, 1-3.

Printout from the R&D Systems website showing a list of available anti-GITR antibodies, Jul. 2, 2014, 1-2.

U.S. Appl. No. 16/793,737, filed Feb. 18, 2020, Suba Krishnan.

U.S. Appl. No. 16/578,987, filed Apr. 27, 2020, S. Shafer.

\* cited by examiner

```
28F3   QVQLVESGGGVVQPGRSLRLSCAASGFTFSSYGMHWVRQAPGKGLEWVAVIWYEGSNKYADSVKGRFTISRDNSKNTLYLQMNSLRAEDTAVYYCARGGSMVRGDYYIGMDVWGQGTTVTVSS
18E10  QVQLVESGGGVVQPGRSLRLSCAASGFTFSSYGMHWVRQAPGKGLEWVAVIWYAGSNKYADSVKGRFTISRDNSKNTLYLQMNSLRAEDTAVYYCARGGRIAVAFYYSMDVWGQGTTVTVSS
19D3   QVQLVESGGGVVQPGRSLRLSCAASGFTFSSYGFHWVRQAPGKGLEWVAVIWYAGSNKFYADSVKGRFTISRDNSKNTLYLQMNSLRAEDTAVYYCARGGQLDYYYYVMDVWGQGTTVTVSS

VL:
28F3   AIQLTQSPSSLSASVGDRVTITCRASQGISSALAWYQQKPGKAPKLLIYDASSLESGVPSRFSGSGSGTDFTLTISSLQPEDFATYYCQQFNSYPYTFGQGTKLEIK
18E10  DIQMTQSPSSLSASVGDRVTITCRASQGISSWLAWYQQKPEKAPKSLIYAASSLQSGVPSRFSGSGSGTDFTLTISSLQPEDFATYYCQQYNSYPYTFGQGTKLEIK
19D3   DIQMTQSPSSLSASVGDRVTITCRASQGISSWLAWYQQKPEKAPKSLIYAASSLQSGVPSRFSGSGSGTDFTLTISSLQPEDFATYYCQQYNSYPYTFGQGTKLEIK
```

Figure 1

Anti-GITR 28F3 VH (hIgG2)

V segment: 3-33
   D segment: 3-10
   J segment: JH6b

```
          Q   V   Q   L   V   E   S   G   G   G   V   V   Q   P   G   R   S
1         CAG GTG CAG CTG GTG GAG TCT GGG GGA GGC GTG GTC CAG CCT GGG AGG TCC

_CDR1_____
          L   R   L   S   C   A   A   S   G   F   T   F   S   S   Y   G   M
52        CTG AGA CTC TCC TGT GCA GCG TCT GGA TTC ACC TTC AGT AGC TAT GGC ATG

___                                                     _CDR2___
          H   W   V   R   Q   A   P   G   K   G   L   E   W   V   A   V   I
103       CAC TGG GTC CGC CAG GCT CCA GGC AAG GGG CTG GAG TGG GTG GCA GTT ATA

W   Y   E   G   S   N   K   Y   Y   A   D   S   V   K   G   R   F
154       TGG TAT GAA GGA AGT AAT AAA TAT TAT GCA GAC TCC GTG AAG GGC CGA TTC

T   I   S   R   D   N   S   K   N   T   L   Y   L   Q   M   N   S
205       ACC ATC TCC AGA GAC AAT TCC AAG AAC ACG CTG TAT CTG CAA ATG AAC AGC

_CDR3_____
          L   R   A   E   D   T   A   V   Y   Y   C   A   R   G   G   S   M
256       CTG AGA GCC GAG GAC ACG GCT GTG TAT TAC TGT GCG AGA GGG GGG AGT ATG

V   R   G   D   Y   Y   Y   G   M   D   V   W   G   Q   G   T   T
307       GTT CGG GGG GAC TAC TAC TAC GGT ATG GAC GTC TGG GGC CAA GGG ACC ACG

V   T   V   S   S
358       GTC ACC GTC TCC TCA
```

Figure 2A

Anti-GITR 28F3 VK (hKappa)

V segment: L18
J segment: JK2

```
        A   I   Q   L   T   Q   S   P   S   S   L   S   A   S   V   G   D
1       GCC ATC CAG TTG ACC CAG TCT CCA TCC TCC CTG TCT GCA TCT GTA GGA GAC

_CDR1_____
        R   V   T   I   T   C   R   A   S   Q   G   I   S   S   A   L   A
52      AGA GTC ACC ATC ACT TGC CGG GCA AGT CAG GGC ATT AGC AGT GCT TTA GCC

_CDR2___
        W   Y   Q   Q   K   P   G   K   A   P   K   L   L   I   Y   D   A
103     TGG TAT CAG CAG AAA CCA GGG AAA GCT CCT AAG CTC CTG ATC TAT GAT GCC

S   S   L   E   S   G   V   P   S   R   F   S   G   S   G   S   G
154     TCC AGT TTG GAA AGT GGG GTC CCA TCA AGG TTC AGC GGC AGT GGA TCT GGG

T   D   F   T   L   T   I   S   S   L   Q   P   E   D   F   A   T
205     ACA GAT TTC ACT CTC ACC ATC AGC AGC CTG CAG CCT GAA GAT TTT GCA ACT

_CDR3_____
        Y   Y   C   Q   Q   F   N   S   Y   P   Y   T   F   G   Q   G   T
256     TAT TAC TGT CAA CAG TTT AAT AGT TAC CCG TAC ACT TTT GGC CAG GGG ACC

K   L   E   I   K
307     AAG CTG GAG ATC AAA
```

Figure 2B

Anti-GITR 18E10 VH (hIgG2)

V segment: 3-33
    D segment: 6-19
    J segment: JH6b

```
          Q   V   Q   L   V   E   S   G   G   G   V   V   Q   P   G   R   S
1         CAG GTG CAG CTG GTG GAG TCT GGG GGA GGC GTG GTC CAG CCT GGG AGG TCC

_CDR1_____
          L   R   L   S   C   A   A   S   G   F   T   F   S   S   Y   G   M
52        CTG AGA CTC TCC TGT GCA GCG TCT GGA TTC ACC TTC AGT AGC TAT GGC ATG

_CDR2____
          H   W   V   R   Q   A   P   G   K   G   L   E   W   V   A   V   I
103       CAC TGG GTC CGC CAG GCT CCA GGC AAG GGG CTG GAG TGG GTG GCA GTT ATA

W   Y   A   G   S   N   K   Y   Y   A   D   S   V   K   G   R   F
154       TGG TAT GCT GGA AGT AAT AAA TAC TAT GCA GAC TCC GTG AAG GGC CGA TTC

T   I   S   R   D   N   S   K   N   T   L   Y   L   Q   M   N   S
205       ACC ATC TCC AGA GAC AAT TCC AAG AAC ACG CTG TAT CTG CAA ATG AAC AGC

_CDR3_____
          L   R   A   E   D   T   A   V   Y   Y   C   A   R   G   G   R   I
256       CTG AGA GCC GAG GAC ACG GCT GTG TAT TAC TGT GCG AGA GGG GGG CGT ATA

A   V   A   F   Y   Y   S   M   D   V   W   G   Q   G   T   T   V
307       GCA GTG GCC TTC TAC TAC AGT ATG GAC GTC TGG GGC CAA GGG ACC ACG GTC

T   V   S   S
358       ACC GTC TCC TCA
```

Figure 3A

Anti-GITR 18E10 VK (hKappa)

V segment: L15
   J segment: JK2

```
        D   I   Q   M   T   Q   S   P   S   S   L   S   A   S   V   G   D
1       GAC ATC CAG ATG ACC CAG TCT CCA TCC TCA CTG TCT GCA TCT GTA GGA GAC

_CDR1_____
        R   V   T   I   T   C   R   A   S   Q   G   I   S   S   W   L   A
52      AGA GTC ACC ATC ACT TGT CGG GCG AGT CAG GGT ATT AGC AGC TGG TTA GCC

_CDR2____
        W   Y   Q   Q   K   P   E   K   A   P   K   S   L   I   Y   A   A
103     TGG TAT CAG CAG AAA CCA GAG AAA GCC CCT AAG TCC CTG ATC TAT GCT GCA

_____
        S   S   L   Q   S   G   V   P   S   R   F   S   G   S   G   S   G
154     TCC AGT TTG CAA AGT GGG GTC CCA TCA AGG TTC AGC GGC AGT GGA TCT GGG

T   D   F   T   L   T   I   S   S   L   Q   P   E   D   F   A   T
205     ACA GAT TTC ACT CTC ACC ATC AGC AGC CTG CAG CCT GAA GAT TTT GCA ACT

_CDR3_____
        Y   Y   C   Q   Q   Y   N   S   Y   P   Y   T   F   G   Q   G   T
256     TAT TAC TGC CAA CAG TAT AAT AGT TAC CCG TAC ACT TTT GGC CAG GGG ACC

K   L   E   I   K
307     AAG CTG GAG ATC AAA
```

Figure 3B

Anti-GITR 19D3 VH (hIgG2)

V segment: 3-33
    D segment: 3-16
    J segment: JH6b

```
          Q   V   Q   L   V   E   S   G   G   G   V   V   Q   P   G   R   S
1         CAG GTG CAG CTG GTG GAG TCT GGG GGA GGC GTG GTC CAA CCT GGG AGG TCC

_CDR1_____
          L   R   L   S   C   A   A   S   G   F   T   F   S   S   Y   G   F
52        CTG AGA CTC TCC TGT GCA GCG TCT GGA TTC ACC TTC AGT AGC TAT GGC TTC

__                                                      _CDR2____
          H   W   V   R   Q   A   P   G   K   G   L   E   W   V   A   V   I
103       CAC TGG GTC CGC CAG GCT CCA GGC AAG GGG CTG GAG TGG GTG GCA GTT ATA
          _____
          W   Y   A   G   S   N   K   F   Y   A   D   S   V   K   G   R   F
154       TGG TAT GCT GGA AGT AAT AAA TTC TAT GCA GAC TCC GTG AAG GGC CGA TTC

T   I   S   R   D   N   S   K   N   T   L   Y   L   Q   M   N   S
205       ACC ATC TCC AGA GAC AAT TCC AAG AAC ACG CTG TAT CTG CAA ATG AAC AGC

_CDR3_____
          L   R   A   E   D   T   A   V   Y   Y   C   A   R   G   G   Q   L
256       CTA AGA GCC GAG GAC ACG GCT GTG TAT TAC TGT GCG AGA GGG GGA CAG TTG
          _____
          D   Y   Y   Y   Y   Y   V   M   D   V   W   G   Q   G   T   T   V
307       GAC TAC TAC TAC TAT TAC GTT ATG GAC GTC TGG GGC CAA GGG ACC ACG GTC

T   V   S   S
358       ACC GTC TCC TCA
```

Figure 4A

Anti-GITR 19D3 VK (hKappa)

V segment: L15
J segment: JK2

```
         D   I   Q   M   T   Q   S   P   S   S   L   S   A   S   V   G   D
1        GAC ATC CAG ATG ACC CAG TCT CCA TCC TCA CTG TCT GCA TCT GTA GGA GAC

_CDR1_____
         R   V   T   I   T   C   R   A   S   Q   G   I   S   S   W   L   A
52       AGA GTC ACC ATC ACT TGT CGG GCG AGT CAG GGT ATT AGC AGC TGG TTA GCC

_CDR2____
         W   Y   Q   Q   K   P   E   K   A   P   K   S   L   I   Y   A   A
103      TGG TAT CAG CAG AAA CCA GAG AAA GCC CCT AAG TCC CTG ATC TAT GCT GCA

_____
         S   S   L   Q   S   G   V   P   S   R   F   S   G   S   G   S   G
154      TCC AGT TTG CAA AGT GGG GTC CCA TCA AGG TTC AGC GGC AGT GGA TCT GGG

T   D   F   T   L   T   I   S   S   L   Q   P   E   D   F   A   T
205      ACA GAT TTC ACT CTC ACC ATC AGC AGC CTG CAG CCT GAA GAT TTT GCA ACT

_CDR3_____
         Y   Y   C   Q   Q   Y   N   S   Y   P   Y   T   F   G   Q   G   T
256      TAT TAC TGC CAA CAG TAT AAT AGT TAC CCG TAC ACT TTT GGC CAG GGG ACC

K   L   E   I   K
307      AAG CTG GAG ATC AAA
```

Figure 4B

Anti-GITR 3C3 VH (hIgG1)

V segment: 4-34
J segment: JH3b

```
1     CAG GTG CAA CTA CAG CAG TGG GGC GCA GGA CTG TTG AAG CCT TCG GAG ACC

_CDR1_____
      L   S   L   T   C   A   V   Y   G   G   S   F   S   G   Y   Y   W
52    CTG TCC CTC ACC TGC GCT GTC TAT GGT GGG TCC TTC AGT GGT TAC TAC TGG

__                                                      _CDR2___
      T   W   I   R   Q   P   P   G   K   G   L   E   W   I   G   K   I
103   ACC TGG ATC CGC CAG CCC CCA GGG AAG GGG CTG GAG TGG ATT GGG AAA ATC

N   H   S   G   N   T   N   Y   N   P   S   L   K   S   R   V   T
154   AAT CAT AGT GGA AAC ACC AAC TAC AAC CCG TCC CTC AAG AGT CGA GTC ACC

I   S   V   D   T   S   K   N   Q   F   S   L   K   L   S   S   V
205   ATA TCA GTA GAC ACG TCC AAG AAC CAG TTC TCC CTG AAG CTG AGC TCT GTG

_CDR3_____
      T   A   A   D   T   A   V   Y   Y   C   A   R   L   G   A   F   D
256   ACC GCC GCG GAC ACG GCT GTG TAT TAC TGT GCG AGA CTG GGG GCC TTT GAT

A   F   D   I   W   G   Q   G   T   M   V   T   V   S   S
307   GCT TTT GAT ATC TGG GGC CAA GGG ACA ATG GTC ACC GTC TCT TCA
```

Figure 5A

Anti-GITR 3C3 VK1 (hKappa)

V segment: L15
J segment: JK2

```
           D   I   Q   M   T   Q   S   P   S   S   L   S   A   S   V   G   D
1          GAC ATC CAG ATG ACC CAG TCT CCA TCC TCA CTG TCT GCA TCT GTA GGA GAC

_CDR1_____
           R   V   T   I   T   C   R   A   S   Q   G   I   S   S   W   L   A
52         AGA GTC ACC ATC ACT TGT CGG GCG AGT CAG GGT ATT AGC AGC TGG TTA GCC

_CDR2____
           W   Y   Q   Q   K   P   E   K   A   P   K   S   L   I   Y   A   A
103        TGG TAT CAG CAG AAA CCA GAG AAA GCC CCT AAG TCC CTG ATC TAT GCT GCA

_____
           S   S   L   Q   S   G   V   P   S   R   F   S   G   S   G   S   G
154        TCC AGT TTG CAA AGT GGG GTC CCA TCA AGG TTC AGC GGC AGT GGA TCT GGG

T   D   F   T   L   T   I   S   S   L   Q   P   E   D   F   A   T
205        ACA GAT TTC ACT CTC ACC ATC AGC AGC CTG CAG CCT GAA GAT TTT GCA ACT

_CDR3_____
           Y   Y   C   Q   Q   Y   N   S   Y   P   Y   T   F   G   Q   G   T
256        TAT TAC TGC CAA CAG TAT AAT AGT TAC CCG TAC ACT TTT GGC CAG GGG ACC

K   L   E   I   K
307        AAG CTG GAG ATC AAA
```

Figure 5B

Anti-GITR 3C3 VK2 (hKappa)

V segment: L20
J segment: JK2

```
           E   I   V   L   T   Q   S   P   A   T   L   S   L   S   P   G   E
1          GAA ATT GTG TTG ACA CAG TCT CCA GCC ACC CTG TCT TTG TCT CCA GGG GAA

_CDR1_____
           R   A   T   L   S   C   R   A   S   Q   G   V   S   S   Y   L   A
52         AGA GCC ACC CTC TCC TGC AGG GCC AGT CAG GGT GTT AGC AGC TAC TTA GCC

_CDR2____
           W   Y   Q   Q   K   P   G   Q   A   P   R   L   L   I   Y   D   A
103        TGG TAC CAG CAG AAA CCT GGC CAG GCT CCC AGG CTC CTC ATC TAT GAT GCA

_____
           S   N   R   A   T   G   I   P   A   R   F   S   G   S   G   P   G
154        TCC AAC AGG GCC ACT GGC ATC CCA GCC AGG TTC AGT GGC AGT GGG CCT GGG

T   D   F   T   L   T   I   S   S   L   E   P   E   D   F   A   V
205        ACA GAC TTC ACT CTC ACC ATC AGC AGC CTA GAG CCT GAA GAT TTT GCA GTT

_CDR3_____
           Y   Y   C   Q   Q   R   S   N   W   H   T   F   G   Q   G   T   K
256        TAT TAC TGT CAG CAG CGT AGC AAC TGG CAC ACT TTT GGC CAG GGG ACC AAG

L   E   I   K
307        CTG GAG ATC AAA
```

Figure 5C

Anti-GITR 2G6 VH (hIgG1)

V segment: 3-33
J segment: JH6b

```
         Q   V   Q   L   V   E   S   G   G   G   V   V   Q   P   G   G   S
  1     CAG GTT CAG CTG GTG GAG TCT GGG GGA GGC GTG GTC CAG CCT GGG GGG TCC

_CDR1_____
         L   R   L   S   C   A   A   S   G   F   I   L   S   D   Y   G   M
 52     CTG AGA CTC TCC TGT GCA GCG TCT GGA TTC ATC TTG AGT GAC TAT GGC ATG

_                                                          _CDR2____
         H   W   V   R   Q   A   P   G   K   G   L   E   W   V   T   V   I
103     CAC TGG GTC CGC CAG GCT CCA GGC AAG GGA CTG GAG TGG GTG ACA GTT ATC

W   Y   D   G   S   N   K   F   Y   V   D   S   V   K   G   R   F
154     TGG TAT GAT GGA AGT AAT AAA TTC TAT GTA GAC TCC GTG AAG GGC CGA TTC

T   I   S   R   D   N   S   K   N   T   L   Y   L   Q   M   N   S
205     ACC ATC TCC AGA GAC AAT TCC AAG AAC ACG TTG TAT CTG CAA ATG AAC AGC

_CDR3_____
         L   R   V   E   D   T   A   V   Y   Y   C   A   R   G   G   R   L
256     CTG AGA GTC GAG GAC ACG GCT GTG TAT TAC TGT GCG AGA GGG GGA CGT CTA

A   T   G   H   F   Y   Y   V   M   D   V   W   G   Q   G   T   T
307     GCA ACA GGT CAC TTC TAC TAC GTT ATG GAC GTC TGG GGC CAA GGG ACC ACG

V   T   V   S   S
358     GTC ACC GTC TCC TCA
```

Figure 6A

Anti-GITR 2G6 VK (hKappa)
V segment: L15
J segment: JK2

```
         D   I   Q   M   T   Q   S   P   S   S   L   S   A   S   V   G   D
1        GAC ATC CAG ATG ACC CAG TCT CCA TCC TCA CTG TCT GCA TCT GTA GGA GAC

_CDR1_____
         R   V   T   I   T   C   R   A   S   Q   G   I   S   S   W   L   A
52       AGA GTC ACC ATC ACT TGT CGG GCG AGT CAG GGT ATT AGC AGC TGG TTA GCC

_CDR2_____
         W   Y   Q   Q   K   P   E   K   A   P   K   S   L   I   Y   A   A
103      TGG TAT CAG CAG AAA CCA GAG AAA GCC CCT AAG TCC CTG ATC TAT GCT GCA

_____
         S   S   L   Q   S   G   V   P   S   R   F   S   G   S   G   S   G
154      TCC AGT TTG CAA AGT GGG GTC CCA TCA AGG TTC AGC GGC AGT GGA TCT GGG

T   D   F   T   L   T   I   S   S   L   Q   P   E   D   F   A   T
205      ACA GAT TTC ACT CTC ACC ATC AGC AGC CTG CAG CCT GAA GAT TTT GCA ACT

_CDR3_____
         Y   Y   C   Q   Q   Y   N   S   Y   P   Y   T   F   G   Q   G   T
256      TAT TAC TGC CAA CAG TAT AAT AGT TAC CCG TAC ACT TTT GGC CAG GGG ACC

K   L   E   I   K
307      AAG CTG GAG ATC AAA
```

Figure 6B

Anti-GITR 8A6 VH (hIgG2)

V segment: 3-33
D segment: 3-10
J segment: JH6b

```
          Q   V   Q   L   V   E   S   G   G   G   V   V   Q   P   G   R   S
  1       CAG GTG CAG CTG GTG GAG TCT GGG GGA GGC GTG GTC CAG CCT GGG AGG TCC

_CDR1_____
          L   R   L   S   C   T   A   S   G   F   T   F   S   S   Y   G   M
 52       CTG AGA CTC TCC TGT ACA GCG TCT GGA TTC ACC TTC AGT AGC TAT GGC ATG

___                                                     _CDR2___
          Q   W   V   R   Q   A   P   G   K   G   L   E   W   V   A   V   I
103       CAG TGG GTC CGC CAG GCT CCA GGC AAG GGG CTG GAG TGG GTG GCA GTT ATA

_____
          W   Y   E   G   S   N   K   Y   Y   A   D   S   V   K   G   R   F
154       TGG TAT GAA GGA AGT AAT AAA TAC TAT GCA GAC TCC GTG AAG GGC CGA TTC

T   I   S   R   E   N   S   K   N   T   L   Y   L   Q   M   N   S
205       ACC ATC TCC AGA GAA AAT TCC AAG AAC ACG CTG TAT CTG CAA ATG AAC AGC

_CDR3_____
          L   R   A   E   D   T   A   V   Y   Y   C   A   R   G   G   L   M
256       CTG AGA GCC GAG GAC ACG GCT GTG TAT TAC TGT GCG AGA GGC GGT CTT ATG

_____
          V   R   G   L   F   Y   Y   G   M   D   V   W   G   Q   G   T   T
307       GTT CGG GGT CTC TTC TAC TAC GGT ATG GAC GTC TGG GGC CAA GGG ACC ACG

V   T   V   S   S
358       GTC ACC GTC TCC TCA
```

Figure 7A

Anti-GITR 8A6 VK (hKappa)
V segment: L18
J segment: JK2

```
         A   I   Q   L   T   Q   S   P   S   S   L   S   A   S   V   G   D
  1      GCC ATC CAG TTG ACC CAG TCT CCA TCC TCC CTG TCT GCA TCT GTA GGA GAC

_CDR1_____
         R   V   T   I   T   C   R   A   S   Q   G   I   S   S   A   L   A
  52     AGA GTC ACC ATC ACT TGC CGG GCA AGT CAG GGC ATT AGC AGT GCT TTA GCC

_CDR2____
         W   Y   Q   Q   K   P   G   K   A   P   K   F   L   I   Y   D   A
  103    TGG TAT CAG CAG AAA CCA GGG AAA GCT CCT AAG TTC CTG ATC TAT GAT GCC

_____
         S   S   L   E   S   G   V   P   S   R   F   S   G   S   G   S   G
  154    TCC AGT TTG GAA AGT GGG GTC CCA TCA AGG TTC AGC GGC AGT GGA TCT GGG

T   D   F   T   L   T   I   S   S   L   Q   P   E   D   F   A   T
  205    ACA GAT TTC ACT CTC ACC ATC AGC AGC CTG CAG CCT GAA GAT TTT GCA ACT

_CDR3_____
         Y   Y   C   Q   Q   F   N   S   Y   P   Y   T   F   G   Q   G   T
  256    TAT TAC TGT CAA CAG TTT AAT AGT TAC CCG TAC ACT TTT GGC CAG GGG ACC

K   L   E   I   K
  307    AAG CTG GAG ATC AAA
```

Figure 7B

Anti-GITR 9G7 VH (hIgG4)

V segment: 3-15
    D segment: 3-10
    J segment: JH6b

```
         E   V   Q   L   V   E   S   G   G   G   L   V   K   P   G   G   S
  1     GAG GTG CAG CTG GTG GAG TCT GGG GGA GGC TTA GTA AAG CCT GGG GGG TCC

_CDR1_____
         L   R   L   S   C   A   A   S   G   F   T   F   S   T   V   W   M
 52     CTT AGA CTC TCC TGT GCA GCC TCT GGA TTC ACT TTC AGT ACC GTC TGG ATG

___                                                       _CDR2____
         S   W   V   R   Q   A   P   G   K   G   L   E   W   V   G   R   I
103     AGC TGG GTC CGC CAG GCT CCA GGG AAG GGG CTG GAG TGG GTT GGC CGT ATT

K   S   K   T   D   G   G   T   T   D   Y   A   A   P   V   K   G
154     AAA AGC AAA ACT GAT GGT GGG ACA ACA GAC TAC GCT GCA CCC GTG AAA GGC

R   F   T   I   S   R   D   D   S   K   N   T   L   Y   L   Q   M
205     AGA TTC ACC ATC TCA AGA GAT GAT TCA AAA AAC ACG CTG TAT CTG CAA ATG

_CDR3____
         N   S   L   H   T   E   D   T   A   V   Y   Y   C   T   T   G   Q
256     AAC AGC CTG CAC ACC GAG GAC ACA GCC GTG TAT TAC TGT ACC ACA GGG CAG

L   I   P   Y   S   Y   Y   Y   G   M   D   V   W   G   Q   G   T
307     CTG ATC CCT TAC TCC TAC TAC TAC GGT ATG GAC GTC TGG GGC CAA GGG ACC

S   V   T   V   S   S
358     TCG GTC ACC GTC TCC TCA
```

Figure 8A

Anti-GITR 9G7 VK1 (hKappa)
V segment: A27
J segment: JK1

```
     E   I   V   L   T   Q   S   P   G   T   L   S   L   S   P   G   E
1            GAA ATT GTG TTG ACG CAG TCT CCA GGC ACC CTG TCT TTG TCT CCA GGG GAA

_CDR1_____
         R   A   T   L   S   C   R   A   S   Q   S   V   S   S   S   Y   L
52       AGA GCC ACC CTC TCC TGC AGG GCC AGT CAG AGT GTT AGC AGC AGC TAC TTA

___                                                                 _CDR2
         A   W   Y   Q   Q   K   P   G   Q   A   P   R   L   L   I   Y   G
103      GCC TGG TAC CAG CAG AAA CCT GGC CAG GCT CCC AGG CTC CTC ATC TAT GGT

_____
         A   S   S   R   A   T   G   I   P   D   R   F   S   G   S   G   S
154      GCA TCC AGC AGG GCC ACT GGC ATC CCA GAC AGG TTC AGT GGC AGT GGG TCT

G   T   D   F   T   L   T   I   S   R   L   E   P   E   D   F   A
205      GGG ACA GAC TTC ACT CTC ACC ATC AGC AGA CTG GAG CCT GAA GAT TTT GCA

_CDR3_____
         V   Y   Y   C   Q   Q   Y   G   S   S   P   W   T   F   G   Q   G
256      GTG TAT TAC TGT CAG CAG TAT GGT AGC TCA CCG TGG ACG TTC GGC CAA GGG

T   K   V   E   I   K
307      ACC AAG GTG GAA ATC AAA
```

Figure 8B

Anti-GITR 9G7 VK2 (hKappa)
V segment: A27
J segment: JK5

```
        E   I   V   L   T   Q   S   P   G   T   L   S   L   S   P   G   E
1       GAA ATT GTG TTG ACG CAG TCT CCA GGC ACC CTG TCT TTG TCT CCA GGG GAA

_CDR1_____
        R   A   T   L   S   C   R   A   S   Q   S   V   T   S   S   Y   L
52      AGA GCC ACC CTC TCC TGC AGG GCC AGT CAG AGT GTT ACC AGC AGC TAC TTA

___                                                         _CDR2
        A   W   Y   Q   Q   K   P   G   Q   A   P   R   L   L   I   Y   G
103     GCC TGG TAC CAG CAG AAA CCT GGC CAG GCT CCC AGG CTC CTC ATC TAT GGT

_____
        A   S   S   R   A   T   G   I   P   E   R   F   S   G   S   G   S
154     GCA TCC AGC AGG GCC ACT GGC ATC CCA GAG AGG TTC AGT GGC AGT GGG TCT

G   T   D   F   T   L   T   I   S   R   L   E   P   E   D   F   A
205     GGG ACA GAC TTC ACT CTC ACC ATC AGC AGA CTG GAG CCT GAA GAT TTT GCA

_CDR3_____
        V   Y   Y   C   Q   Q   Y   G   S   S   P   I   T   F   G   Q   G
256     GTG TAT TAC TGT CAG CAG TAT GGT AGC TCA CCG ATC ACC TTC GGC CAA GGG

T   R   L   E   I   K
307     ACA CGA CTG GAG ATT AAA
```

Figure 8C

Anti-GITR 14E3 VH (hIgG1)

V segment: 4-34
J segment: JH3b

```
       Q   V   Q   L   Q   Q   W   G   A   G   L   L   K   P   S   E   T
1      CAG GTG CAG CTA CAG CAG TGG GGC GCA GGA CTG TTG AAG CCT TCG GAG ACC

_CDR1_____
       L   S   L   T   C   A   V   Y   G   G   S   F   S   G   Y   Y   W
52     CTG TCC CTC ACC TGC GCT GTC TAT GGT GGG TCC TTC AGT GGT TAC TAC TGG

__                                                        _CDR2____
       S   W   I   R   Q   P   P   G   K   G   L   E   W   I   G   E   I
103    AGC TGG ATC CGC CAG CCC CCA GGG AAG GGG CTG GAG TGG ATT GGA GAA ATC

_____
       N   H   S   G   N   T   Y   Y   N   P   S   L   K   S   R   V   T
154    AAT CAT AGT GGA AAC ACC TAC TAC AAC CCG TCC CTC AAG AGT CGC GTC ACC

I   S   V   D   T   S   K   N   Q   L   S   L   K   L   S   S   V
205    ATA TCA GTA GAC ACG TCC AAG AAC CAG TTA TCC CTG AAG CTG AGC TCT GTG

_CDR3_____
       T   A   A   D   T   A   V   Y   Y   C   A   R   F   G   S   N   D
256    ACC GCC GCG GAC ACG GCT GTG TAT TAC TGT GCG AGA TTT GGG AGT AAT GAT

_____
       A   F   D   I   W   G   Q   G   T   M   V   T   V   S   S
307    GCT TTT GAT ATC TGG GGC CAA GGG ACA ATG GTC ACC GTC TCT TCA
```

Figure 9A

Anti-GITR 14E3 VK (hKappa)
V segment: L15
J segment: JK1

```
        D   I   Q   M   T   Q   S   P   S   S   L   S   A   S   V   G   D
1       GAC ATC CAG ATG ACC CAG TCT CCA TCC TCA CTG TCT GCA TCT GTA GGA GAC

_CDR1_____
        R   V   T   I   T   C   R   A   S   Q   G   I   S   S   W   L   A
52      AGA GTC ACC ATC ACT TGT CGG GCG AGT CAG GGT ATT AGC AGC TGG TTA GCC

_CDR2___
        W   Y   Q   Q   K   P   E   K   A   P   K   S   L   I   Y   A   A
103     TGG TAT CAG CAG AAA CCA GAG AAA GCC CCT AAG TCC CTG ATC TAT GCT GCA

_____
        S   S   L   Q   S   G   V   P   S   R   F   S   G   S   G   S   G
154     TCC AGT TTG CAA AGT GGG GTC CCA TCA AGG TTC AGC GGC AGT GGA TCT GGG

T   D   F   T   L   T   I   S   S   L   Q   P   E   D   F   A   T
205     ACA GAT TTC ACT CTC ACC ATC AGC AGC CTG CAG CCT GAA GAT TTT GCA ACT

_CDR3_____
        Y   Y   C   Q   Q   Y   N   S   Y   P   P   T   F   G   Q   G   T
256     TAT TAC TGC CAA CAG TAT AAT AGT TAC CCT CCG ACG TTC GGC CAA GGG ACC

K   V   E   I   K
307     AAG GTG GAA ATC AAA
```

Figure 9B

Anti-GITR 19H8 VH (hIgG2)

V segment: 3-33
D segment: 3-10
J segment: JH6b

```
          Q   V   Q   L   V   E   S   G   G   G   V   V   Q   P   G   R   S
1         CAG GTG CAG CTG GTG GAG TCT GGG GGA GGC GTG GTC CAG CCT GGG AGG TCC

_CDR1_____
          L   R   L   S   C   A   A   S   G   F   T   F   S   N   Y   G   M
52        CTG AGA CTC TCC TGT GCA GCG TCT GGA TTC ACC TTC AGT AAC TAT GGC ATG

___                                                 _CDR2__
          H   W   V   R   Q   A   P   G   K   G   L   E   W   M   A   V   I
103       CAC TGG GTC CGC CAG GCT CCA GGC AAG GGG CTG GAG TGG ATG GCA GTT ATA

W   Y   G   G   S   N   K   F   Y   A   D   S   V   K   G   R   F
154       TGG TAT GGT GGA AGT AAT AAA TTC TAT GCA GAC TCC GTG AAG GGC CGA TTC

T   I   S   R   D   N   S   K   N   S   L   S   L   Q   M   N   S
205       ACC ATC TCC AGA GAC AAT TCC AAG AAC TCG CTG TCT CTG CAA ATG AAC AGC

_CDR3_____
          L   R   A   E   D   T   A   V   Y   Y   C   A   R   G   G   A   M
256       CTG AGA GCC GAG GAC ACG GCT GTG TAT TAC TGT GCG AGA GGG GGG GCT ATG

V   R   G   V   Y   Y   Y   G   M   D   V   W   G   Q   G   T   T
307       GTT CGG GGA GTC TAC TAC TAC GGT ATG GAC GTC TGG GGC CAA GGG ACC ACG

V   T   V   S   S
358       GTC ACC GTC TCC TCA
```

Figure 10A

Anti-GITR 19H8 VK1 (hKappa)
V segment: L18
J segment: JK1

```
       A   I   Q   L   T   Q   S   P   S   S   L   S   A   S   V   G   D
1      GCC ATC CAG TTG ACC CAG TCT CCA TCC TCC CTG TCT GCA TCT GTA GGA GAC

_CDR1_____
       R   V   T   I   T   C   R   A   S   Q   G   I   S   S   A   L   A
52     AGA GTC ACC ATC ACT TGC CGG GCA AGT CAG GGC ATT AGC AGT GCT TTA GCC

_CDR2____
       W   Y   Q   Q   K   P   G   K   A   P   K   F   L   I   Y   D   A
103    TGG TAT CAG CAG AAA CCA GGG AAA GCT CCT AAG TTC CTG ATC TAT GAT GCC

_____
       S   S   L   E   S   G   V   P   S   R   F   S   G   S   G   S   G
154    TCC AGT TTG GAA AGT GGG GTC CCA TCA AGG TTC AGC GGC AGT GGA TCT GGG

T   D   F   T   L   T   I   S   S   L   Q   P   E   D   F   A   T
205    ACA GAT TTC ACT CTC ACC ATC AGC AGC CTG CAG CCT GAA GAT TTT GCA ACT

_CDR3_____
       Y   Y   C   Q   Q   F   N   S   Y   P   Q   T   F   G   Q   G   T
256    TAT TAC TGT CAA CAG TTT AAT AGT TAC CCT CAG ACG TTC GGC CAA GGG ACC

K   V   E   I   K
307    AAG GTG GAA ATC AAA
```

Figure 10B

Anti-GITR 19H8 VK2 (hKappa)
V segment: L6
J segment: JK4

```
        E   I   V   L   T   Q   S   P   A   T   L   S   L   S   P   G   E
1       GAA ATT GTG TTG ACA CAG TCT CCA GCC ACC CTG TCT TTG TCT CCA GGG GAA

_CDR1_____
        R   A   T   L   S   C   R   A   S   Q   S   V   S   S   Y   L   A
52      AGA GCC ACC CTC TCC TGC AGG GCC AGT CAG AGT GTT AGC AGC TAC TTA GCC

_CDR2____
        W   Y   Q   Q   K   P   G   Q   A   P   R   L   L   I   Y   D   A
103     TGG TAC CAA CAG AAA CCT GGC CAG GCT CCC AGG CTC CTC ATC TAT GAT GCA

_____
        S   N   R   A   T   G   I   P   A   R   F   S   G   S   G   S   G
154     TCC AAC AGG GCC ACT GGC ATC CCA GCC AGG TTC AGT GGC AGT GGG TCT GGG

T   D   F   T   L   T   I   S   S   L   E   P   E   D   F   A   V
205     ACA GAC TTC ACT CTC ACC ATC AGC AGC CTA GAG CCT GAA GAT TTT GCA GTT

_CDR3_____
        Y   Y   C   Q   Q   R   S   N   W   P   L   T   F   G   G   G   T
256     TAT TAC TGT CAG CAG CGT AGC AAC TGG CCG CTC ACT TTC GGC GGA GGG ACC

K   V   E   I   K
307     AAG GTG GAG ATC AAA
```

Figure 10C

Anti-GITR 6G10 VH (hIgG2)

V segment: 3-33
    D segment: 3-10
    J segment: JH6b

```
          Q   V   Q   L   V   E   S   G   G   D   V   V   Q   P   G   R   S
1         CAG GTG CAG CTG GTG GAG TCT GGG GGA GAC GTG GTC CAG CCT GGG AGG TCC

_CDR1_____
          L   R   L   S   C   A   A   S   G   F   T   F   S   T   Y   G   M
52        CTG AGA CTC TCC TGT GCA GCG TCT GGA TTC ACC TTC AGT ACC TAT GGC ATG

___                                                   _CDR2____
          H   W   V   R   Q   A   P   G   K   G   L   E   W   V   A   V   T
103       CAC TGG GTC CGC CAG GCT CCA GGC AAG GGG CTG GAG TGG GTG GCA GTT ACA

_____
          W   Y   A   G   S   N   K   F   Y   A   D   S   V   K   G   R   F
154       TGG TAT GCT GGA AGT AAT AAA TTT TAT GCA GAC TCC GTG AAG GGC CGA TTC

T   I   S   R   D   N   S   K   N   T   L   Y   L   Q   M   N   S
205       ACC ATC TCC AGA GAC AAT TCC AAG AAC ACG CTG TAT CTG CAA ATG AAC AGC

_CDR3_____
          L   R   A   E   D   T   A   V   Y   Y   C   A   R   G   G   S   M
256       CTG AGA GCC GAG GAC ACG GCT GTG TAT TAC TGT GCG AGA GGA GGT AGT ATG

_____
          V   R   G   L   Y   Y   Y   G   M   D   V   W   G   Q   G   T   T
307       GTT CGG GGA CTT TAT TAT TAC GGT ATG GAC GTC TGG GGC CAA GGG ACC ACG

V   T   V   S   S
358       GTC ACC GTC TCC TCA
```

Figure 11A

Anti-GITR 6G10 VK1 (hKappa)
V segment: L18
J segment: JK2

```
          A   I   Q   L   T   Q   S   P   S   S   L   S   A   S   V   G   D
1         GCC ATC CAG TTG ACC CAG TCT CCA TCC TCC CTG TCT GCA TCT GTA GGA GAC

_CDR1_____
          R   V   T   I   T   C   R   A   S   Q   G   I   S   S   A   L   A
52        AGA GTC ACC ATC ACT TGC CGG GCA AGT CAG GGC ATT AGC AGT GCT TTA GCC

_CDR2___
          W   Y   Q   Q   K   P   G   K   A   P   K   L   L   I   Y   D   A
103       TGG TAT CAG CAG AAA CCA GGG AAA GCT CCT AAG CTC CTG ATC TAT GAT GCC

_____
          S   S   L   E   S   G   V   P   S   R   F   S   G   S   G   S   G
154       TCC AGT TTG GAA AGT GGG GTC CCA TCA AGG TTC AGC GGC AGT GGA TCT GGG

T   D   F   T   L   T   I   S   S   L   Q   P   E   D   F   A   T
205       ACA GAT TTC ACT CTC ACC ATC AGC AGC CTG CAG CCT GAA GAT TTT GCA ACT

_CDR3_____
          Y   Y   C   Q   Q   F   N   S   Y   P   Y   T   F   G   Q   G   T
256       TAT TAC TGT CAA CAG TTT AAT AGT TAC CCG TAC ACT TTT GGC CAG GGG ACC

K   L   E   I   K
307       AAG CTG GAG ATC AAA
```

Figure 11B

Anti-GITR 28F3 VH (hIgG2)

```
3-33      Q  V  Q  L  V  E  S  G  G  G  V  V  Q  P  G  R  S  L  R  L  S  C  A
28F3 VH   -  -  -  -  -  -  -  -  -  -  -  -  -  -  -  -  -  -  -  -  -  -  -

_CDR1_____
3-33      A  S  G  F  T  F  S  S  Y  G  M  H  W  V  R  Q  A  P  G  K  G  L  E
28F3 VH   -  -  -  -  -  -  -  -  -  -  -  -  -  -  -  -  -  -  -  -  -  -  -

_CDR2_____
3-33      W  V  A  V  I  W  Y  D  G  S  N  K  Y  Y  A  D  S  V  K  G  R  F  T
28F3 VH   -  -  -  -  -  -  -  E  -  -  -  -  -  -  -  -  -  -  -  -  -  -  -

3-33      I  S  R  D  N  S  K  N  T  L  Y  L  Q  M  N  S  L  R  A  E  D  T  A
28F3 VH   -  -  -  -  -  -  -  -  -  -  -  -  -  -  -  -  -  -  -  -  -  -  -

_CDR3_____
3-33      V  Y  Y  C  A  R
3-10                         M  V  R  G
JH6                                         Y  Y  Y  G  M  D  V  W  G
28F3 VH   -  -  -  -  -  -  G  G  S  -  -  -  -  D  -  -  -  -  -  -  -  -  -

Anti-GITR 28F3 VK (hKappa)

```
L18      A  I  Q  L  T  Q  S  P  S  S  L  S  A  S  V  G  D  R  V  T  I  T  C
28F3 VK  -  -  -  -  -  -  -  -  -  -  -  -  -  -  -  -  -  -  -  -  -  -  -

_CDR1_____
L18      R  A  S  Q  G  I  S  S  A  L  A  W  Y  Q  Q  K  P  G  K  A  P  K  L
28F3 VK  -  -  -  -  -  -  -  -  -  -  -  -  -  -  -  -  -  -  -  -  -  -  -

_CDR2_____
L18      L  I  Y  D  A  S  S  L  E  S  G  V  P  S  R  F  S  G  S  G  S  G  T
28F3 VK  -  -  -  -  -  -  -  -  -  -  -  -  -  -  -  -  -  -  -  -  -  -  -

_CDR3_____
L18      D  F  T  L  T  I  S  S  L  Q  P  E  D  F  A  T  Y  Y  C  Q  Q  F  N
28F3 VK  -  -  -  -  -  -  -  -  -  -  -  -  -  -  -  -  -  -  -  -  -  -  -

Anti-GITR 18E10 VH (hIgG2)

```
3-33     Q  V  Q  L  V  E  S  G  G  G  V  V  Q  P  G  R  S  L  R  L  S  C  A
18E10 VH -  -  -  -  -  -  -  -  -  -  -  -  -  -  -  -  -  -  -  -  -  -  -

_CDR1_____
3-33     A  S  G  F  T  F  S  S  Y  G  M  H  W  V  R  Q  A  P  G  K  G  L  E
18E10 VH -  -  -  -  -  -  -  -  -  -  -  -  -  -  -  -  -  -  -  -  -  -  -

_CDR2_____
3-33     W  V  A  V  I  W  Y  D  G  S  N  K  Y  Y  A  D  S  V  K  G  R  F  T
18E10 VH -  -  -  -  -  -  -  A  -  -  -  -  -  -  -  -  -  -  -  -  -  -  -

3-33     I  S  R  D  N  S  K  N  T  L  Y  L  Q  M  N  S  L  R  A  E  D  T  A
18E10 VH -  -  -  -  -  -  -  -  -  -  -  -  -  -  -  -  -  -  -  -  -  -  -

_CDR3_____
3-33     V  Y  Y  C  A  R
6-19                       I  A  V  A
JH6                                          Y  Y  G  M  D  V  W  G  Q
18E10 VH -  -  -  -  -  -  G  G  R  -  -  -  -  F  -  -  S  -  -  -  -  -  -

Anti-GITR 18E10 VK (hKappa)

```
L15        D  I  Q  M  T  Q  S  P  S  S  L  S  A  S  V  G  D  R  V  T  I  T  C
18E10 VK   -  -  -  -  -  -  -  -  -  -  -  -  -  -  -  -  -  -  -  -  -  -  -

_CDR1_____
L15        R  A  S  Q  G  I  S  S  W  L  A  W  Y  Q  Q  K  P  E  K  A  P  K  S
18E10 VK   -  -  -  -  -  -  -  -  -  -  -  -  -  -  -  -  -  -  -  -  -  -  -

_CDR2_____
L15        L  I  Y  A  A  S  L  Q  S  G  V  P  S  R  F  S  G  S  G  S  G  T
18E10 VK   -  -  -  -  -  -  -  -  -  -  -  -  -  -  -  -  -  -  -  -  -  -

_CDR3_____
L15        D  F  T  L  T  I  S  S  L  Q  P  E  D  F  A  T  Y  Y  C  Q  Q  Y  N
18E10 VK   -  -  -  -  -  -  -  -  -  -  -  -  -  -  -  -  -  -  -  -  -  -  -

Anti-GITR 19D3 VH (hIgG2)

```
3-33     Q  V  Q  L  V  E  S  G  G  V  V  Q  P  G  R  S  L  R  L  S  C  A
19D3 VH  -  -  -  -  -  -  -  -  -  -  -  -  -  -  -  -  -  -  -  -  -  -

_CDR1_____
3-33     A  S  G  F  T  F  S  S  Y  G  M  H  W  V  R  Q  A  P  G  K  G  L  E
19D3 VH  -  -  -  -  -  -  -  -  -  -  F  -  -  -  -  -  -  -  -  -  -  -  -

_CDR2_____
3-33     W  V  A  V  I  W  Y  D  G  S  N  K  Y  Y  A  D  S  V  K  G  R  F  T
19D3 VH  -  -  -  -  -  -  -  A  -  -  -  -  F  -  -  -  -  -  -  -  -  -  -

3-33     I  S  R  D  N  S  K  N  T  L  Y  L  Q  M  N  S  L  R  A  E  D  T  A
19D3 VH  -  -  -  -  -  -  -  -  -  -  -  -  -  -  -  -  -  -  -  -  -  -  -

_CDR3_____
3-33     V  Y  Y  C  A  R
3-16                                    D  Y
JH6                                           Y  Y  Y  Y  Y  G  M  D  V  W  G  Q
19D3 VH  -  -  -  -  -  -  G  G  Q  L  -  -  -  -  -  -  V  -  -  -  -  -

Anti-GITR 19D3 VK (hKappa)

```
L15       D  I  Q  M  T  Q  S  P  S  S  L  S  A  S  V  G  D  R  V  T  I  T  C
19D3 VK   -  -  -  -  -  -  -  -  -  -  -  -  -  -  -  -  -  -  -  -  -  -  -

_CDR1_____
L15       R  A  S  Q  G  I  S  S  W  L  A  W  Y  Q  Q  K  P  E  K  A  P  K  S
19D3 VK   -  -  -  -  -  -  -  -  -  -  -  -  -  -  -  -  -  -  -  -  -  -  -

_CDR2_____
L15       L  I  Y  A  A  S  S  L  Q  S  G  V  P  S  R  F  S  G  S  G  S  G  T
19D3 VK   -  -  -  -  -  -  -  -  -  -  -  -  -  -  -  -  -  -  -  -  -  -  -

_CDR3_____
L15       D  F  T  L  T  I  S  S  L  Q  P  E  D  F  A  T  Y  Y  C  Q  Q  Y  N
19D3 VK   -  -  -  -  -  -  -  -  -  -  -  -  -  -  -  -  -  -  -  -  -  -  -

Anti-GITR 3C3 VH (hIgG1)

```
4-34    Q  V  Q  L  Q  Q  W  G  A  G  L  L  K  P  S  E  T  L  S  L  T  C  A
INPUT   -  -  -  -  -  -  -  -  -  -  -  -  -  -  -  -  -  -  -  -  -  -  -

_CDR1_____
4-34    V  Y  G  G  S  F  S  G  Y  Y  W  S  W  I  R  Q  P  P  G  K  G  L  E
INPUT   -  -  -  -  -  -  -  -  -  -  -  T  -  -  -  -  -  -  -  -  -  -  -

_CDR2_____
4-34    W  I  G  E  I  N  H  S  G  S  T  N  Y  N  P  S  L  K  S  R  V  T  I
INPUT   -  -  -  K  -  -  -  -  -  N  -  -  -  -  -  -  -  -  -  -  -  -  -

4-34    S  V  D  T  S  K  N  Q  F  S  L  K  L  S  S  V  T  A  A  D  T  A  V
INPUT   -  -  -  -  -  -  -  -  -  -  -  -  -  -  -  -  -  -  -  -  -  -  -

_CDR3_____
4-34    Y  Y  C  A  R
JH3                          D  A  F  D  I  W  G  Q  G  T  M  V  T  V
INPUT   -  -  -  -  -  L  G  A  F  -  -  -  -  -  -  -  -  -  -  -  -

JH3     S  S
INPUT   -  -
```

Figure 18

Anti-GITR 3C3 VK1 (hKappa)

```
L15     D  I  Q  M  T  Q  S  P  S  S  L  S  A  S  V  G  D  R  V  T  I  T  C
INPUT   -  -  -  -  -  -  -  -  -  -  -  -  -  -  -  -  -  -  -  -  -  -  -

_CDR1_____
L15     R  A  S  Q  G  I  S  S  W  L  A  W  Y  Q  Q  K  P  E  K  A  P  K  S
INPUT   -  -  -  -  -  -  -  -  -  -  -  -  -  -  -  -  -  -  -  -  -  -  -

_CDR2_____
L15     L  I  Y  A  A  S  L  Q  S  G  V  P  S  R  F  S  G  S  G  S  G  T
INPUT   -  -  -  -  -  -  -  -  -  -  -  -  -  -  -  -  -  -  -  -  -  -

_CDR3_____
L15     D  F  T  L  T  I  S  S  L  Q  P  E  D  F  A  T  Y  Y  C  Q  Q  Y  N
INPUT   -  -  -  -  -  -  -  -  -  -  -  -  -  -  -  -  -  -  -  -  -  -  -

_____
L15     S  Y
JK2           Y  T  F  G  Q  G  T  K  L  E  I  K
INPUT   -  -  P  -  -  -  -  -  -  -  -  -  -  -
```

Figure 19A

Anti-GITR 3C3 VK2 (hKappa)

```
L20      E  I  V  L  T  Q  S  P  A  T  L  S  L  S  P  G  E  R  A  T  L  S  C
INPUT    -  -  -  -  -  -  -  -  -  -  -  -  -  -  -  -  -  -  -  -  -  -  -

_CDR1_____
L20      R  A  S  Q  G  V  S  S  Y  L  A  W  Y  Q  Q  K  P  G  Q  A  P  R  L
INPUT    -  -  -  -  -  -  -  -  -  -  -  -  -  -  -  -  -  -  -  -  -  -  -

_CDR2_____
L20      L  I  Y  D  A  S  N  R  A  T  G  I  P  A  R  F  S  G  S  G  P  G  T
INPUT    -  -  -  -  -  -  -  -  -  -  -  -  -  -  -  -  -  -  -  -  -  -  -

_CDR3_____
L20      D  F  T  L  T  I  S  S  L  E  P  E  D  F  A  V  Y  Y  C  Q  Q  R  S
INPUT    -  -  -  -  -  -  -  -  -  -  -  -  -  -  -  -  -  -  -  -  -  -  -

_____
L20      N  W
JK2            T  F  G  Q  G  T  K  L  E  I  K
INPUT    -  -  H  -  -  -  -  -  -  -  -  -  -
```

Figure 19B

Anti-GITR 2G6 VH (hIgG2)

```
3-33    Q  V  Q  L  V  E  S  G  G  G  V  V  Q  P  G  R  S  L  R  L  S  C  A
INPUT   -  -  -  -  -  -  -  -  -  -  -  -  -  -  -  G  -  -  -  -  -  -  -

_CDR1_____
3-33    A  S  G  F  T  F  S  S  Y  G  M  H  W  V  R  Q  A  P  G  K  G  L  E
INPUT   -  -  -  -  I  L  -  D  -  -  -  -  -  -  -  -  -  -  -  -  -  -  -

_CDR2_____
3-33    W  V  A  V  I  W  Y  D  G  S  N  K  Y  Y  A  D  S  V  K  G  R  F  T
INPUT   -  -  T  -  -  -  -  -  -  -  -  -  F  -  V  -  -  -  -  -  -  -  -

3-33    I  S  R  D  N  S  K  N  T  L  Y  L  Q  M  N  S  L  R  A  E  D  T  A
INPUT   -  -  -  -  -  -  -  -  -  -  -  -  -  -  -  -  -  -  V  -  -  -  -

_CDR3_____
3-33    V  Y  Y  C  A  R
JH6                                                  Y  Y  G  M  D  V  W  G
INPUT   -  -  -  -  -  -  G  G  R  L  A  T  G  H  F  -  -  V  -  -  -  -  -

JH6     Q  G  T  T  V  T  V  S  S
INPUT   -  -  -  -  -  -  -  -  -
```

Figure 20

Anti-GITR 2G6 VK (hKappa)

```
L15      D  I  Q  M  T  Q  S  P  S  S  L  S  A  S  V  G  D  R  V  T  I  T  C
INPUT    -  -  -  -  -  -  -  -  -  -  -  -  -  -  -  -  -  -  -  -  -  -  -

_CDR1_____
L15      R  A  S  Q  G  I  S  S  W  L  A  W  Y  Q  Q  K  P  E  K  A  P  K  S
INPUT    -  -  -  -  -  -  -  -  -  -  -  -  -  -  -  -  -  -  -  -  -  -  -

_CDR2_____
L15      L  I  Y  A  A  S  L  Q  S  G  V  P  S  R  F  S  G  S  G  S  G  T
INPUT    -  -  -  -  -  -  -  -  -  -  -  -  -  -  -  -  -  -  -  -  -  -

_CDR3_____
L15      D  F  T  L  T  I  S  S  L  Q  P  E  D  F  A  T  Y  Y  C  Q  Q  Y  N
INPUT    -  -  -  -  -  -  -  -  -  -  -  -  -  -  -  -  -  -  -  -  -  -  -

_____
L15      S  Y
JK2            Y  T  F  G  Q  G  T  K  L  E  I  K
INPUT    -  -  P  -  -  -  -  -  -  -  -  -  -  -
```

Figure 21

Anti-GITR 8A6 VH (hIgG2)

```
3-33    Q  V  Q  L  V  E  S  G  G  G  V  V  Q  P  G  R  S  L  R  L  S  C  A
INPUT   -  -  -  -  -  -  -  -  -  -  -  -  -  -  -  -  -  -  -  -  -  -  T

_CDR1_____
3-33    A  S  G  F  T  F  S  S  Y  G  M  H  W  V  R  Q  A  P  G  K  G  L  E
INPUT   -  -  -  -  -  -  -  -  -  -  Q  -  -  -  -  -  -  -  -  -  -  -  -

_CDR2_____
3-33    W  V  A  V  I  W  Y  D  G  S  N  K  Y  Y  A  D  S  V  K  G  R  F  T
INPUT   -  -  -  -  -  -  -  E  -  -  -  -  -  -  -  -  -  -  -  -  -  -  -

3-33    I  S  R  D  N  S  K  N  T  L  Y  L  Q  M  N  S  L  R  A  E  D  T  A
INPUT   -  -  -  E  -  -  -  -  -  -  -  -  -  -  -  -  -  -  -  -  -  -  -

_CDR3_____
3-33    V  Y  Y  C  A  R
3-10                         M  V  R  G
JH6                                            Y  Y  G  M  D  V  W  G
INPUT   -  -  -  -  -  -  G  G  L  -  -  -  -  L  F  -  -  -  -  -  -  -

JH6     Q  G  T  T  V  T  V  S  S
INPUT   -  -  -  -  -  -  -  -  -
```

Figure 22

Anti-GITR 8A6 VK (hKappa)

```
L18     A  I  Q  L  T  Q  S  P  S  S  L  S  A  S  V  G  D  R  V  T  I  T  C
INPUT   -  -  -  -  -  -  -  -  -  -  -  -  -  -  -  -  -  -  -  -  -  -  -

_CDR1_____
L18     R  A  S  Q  G  I  S  S  A  L  A  W  Y  Q  Q  K  P  G  K  A  P  K  L
INPUT   -  -  -  -  -  -  -  -  -  -  -  -  -  -  -  -  -  -  -  -  -  -  F

_CDR2_____
L18     L  I  Y  D  A  S  S  L  E  S  G  V  P  S  R  F  S  G  S  G  S  G  T
INPUT   -  -  -  -  -  -  -  -  -  -  -  -  -  -  -  -  -  -  -  -  -  -  -

_CDR3_____
L18     D  F  T  L  T  I  S  S  L  Q  P  E  D  F  A  T  Y  Y  C  Q  Q  F  N
INPUT   -  -  -  -  -  -  -  -  -  -  -  -  -  -  -  -  -  -  -  -  -  -  -

_____
L18     N  Y
JK2           Y  T  F  G  Q  G  T  K  L  E  I  K
INPUT   S  -  P  -  -  -  -  -  -  -  -  -  -
```

Figure 23

Anti-GITR 9G7 VH (hIgG4)

```
3-15    E  V  Q  L  V  E  S  G  G  G  L  V  K  P  G  G  S  L  R  L  S  C  A
INPUT   -  -  -  -  -  -  -  -  -  -  -  -  -  -  -  -  -  -  -  -  -  -  -

_CDR1_____
3-15    A  S  G  F  T  F  S  N  A  W  M  S  W  V  R  Q  A  P  G  K  G  L  E
INPUT   -  -  -  -  -  -  -  T  V  -  -  -  -  -  -  -  -  -  -  -  -  -  -

_CDR2_____
3-15    W  V  G  R  I  K  S  K  T  D  G  G  T  T  D  Y  A  A  P  V  K  G  R
INPUT   -  -  -  -  -  -  -  -  -  -  -  -  -  -  -  -  -  -  -  -  -  -  -

3-15    F  T  I  S  R  D  D  S  K  N  T  L  Y  L  Q  M  N  S  L  K  T  E  D
INPUT   -  -  -  -  -  -  -  -  -  -  -  -  -  -  -  -  -  -  H  -  -  -  -

_CDR3_____
3-15    T  A  V  Y  Y  C  T  T
3-10                                              Y  Y  Y  G
JH6                                         Y  Y  Y  Y  Y  G  M  D  V  W
INPUT   -  -  -  -  -  -  -  -  G  Q  L  I  P  -  S  -  -  -  -  -  -  -  -

JH6     G  Q  G  T  T  V  T  V  S  S
INPUT   -  -  -  -  S  -  -  -  -  -
```

Figure 24

Anti-GITR 9G7 VK1 (hKappa)

```
A27      E  I  V  L  T  Q  S  P  G  T  L  S  L  S  P  G  E  R  A  T  L  S  C
INPUT    -  -  -  -  -  -  -  -  -  -  -  -  -  -  -  -  -  -  -  -  -  -  -

_CDR1_____
A27      R  A  S  Q  S  V  S  S  Y  L  A  W  Y  Q  Q  K  P  G  Q  A  P  R
INPUT    .  .  .  .  .  .  .  .  .  .  .  .  .  .  .  .  .  .  .  .  .  .

_CDR2_____
A27      L  L  I  Y  G  A  S  S  R  A  T  G  I  P  D  R  F  S  G  S  G  S  G
INPUT    -  -  -  -  -  -  -  -  -  -  -  -  -  -  -  -  -  -  -  -  -  -  -

_CDR3___
A27      T  D  F  T  L  T  I  S  R  L  E  P  E  D  F  A  V  Y  Y  C  Q  Q  Y
INPUT    -  -  -  -  -  -  -  -  -  -  -  -  -  -  -  -  -  -  -  -  -  -  -

_____
A27      G  S  S
JK1                  W  T  F  G  Q  G  T  K  V  E  I  K
INPUT    -  -  -  P  -  -  -  -  -  -  -  -  -  -  -  -
```

Figure 25A

Anti-GITR 9G7 VK2 (hKappa)

```
A27     E  I  V  L  T  Q  S  P  G  T  L  S  L  S  P  G  E  R  A  T  L  S  C
INPUT   -  -  -  -  -  -  -  -  -  -  -  -  -  -  -  -  -  -  -  -  -  -  -

_CDR1_____
A27     R  A  S  Q  S  V  S  S  S  Y  L  A  W  Y  Q  Q  K  P  G  Q  A  P  R
INPUT   -  -  -  -  -  -  T  -  -  -  -  -  -  -  -  -  -  -  -  -  -  -  -

_CDR2_____
A27     L  L  I  Y  G  A  S  S  R  A  T  G  I  P  D  R  F  S  G  S  G  S  G
INPUT   -  -  -  -  -  -  -  -  -  -  -  -  -  -  E  -  -  -  -  -  -  -  -

_CDR3___
A27     T  D  F  T  L  T  I  S  R  L  E  P  E  D  F  A  V  Y  Y  C  Q  Q  Y
INPUT   -  -  -  -  -  -  -  -  -  -  -  -  -  -  -  -  -  -  -  -  -  -  -

_____
A27     G  S  S
JK5                 I  T  F  G  Q  G  T  R  L  E  I  K
INPUT   -  -  -  P  -  -  -  -  -  -  -  -  -  -  -  -
```

Figure 25B

Anti-GITR 14E3 VH (hIgG1)

```
4-34      Q   V   Q   L   Q   Q   W   G   A   G   L   L   K   P   S   E   T   L   S   L   T   C   A
INPUT     -   -   -   -   -   -   -   -   -   -   -   -   -   -   -   -   -   -   -   -   -   -   -

_CDR1_____
4-34      V   Y   G   G   S   F   S   G   Y   Y   W   S   W   I   R   Q   P   P   G   K   G   L   E
INPUT     -   -   -   -   -   -   -   -   -   -   -   -   -   -   -   -   -   -   -   -   -   -   -

_CDR2_____
4-34      W   I   G   E   I   N   H   S   G   S   T   N   Y   N   P   S   L   K   S   R   V   T   I
INPUT     -   -   -   -   -   -   -   -   -   N   -   Y   -   -   -   -   -   -   -   -   -   -   -

4-34      S   V   D   T   S   K   N   Q   F   S   L   K   L   S   S   V   T   A   A   D   T   A   V
INPUT     -   -   -   -   -   -   -   -   L   -   -   -   -   -   -   -   -   -   -   -   -   -   -

_CDR3_____
4-34      Y   Y   C   A   R
JH3                               D   A   F   D   I   W   G   Q   G   T   M   V   T   V
INPUT     -   -   -   -   -   F   G   S   N   -   -   -   -   -   -   -   -   -   -   -

JH3       S   S
INPUT     -   -
```

Figure 26

Anti-GITR 14E3 VK (hKappa)

```
L15     D  I  Q  M  T  Q  S  P  S  S  L  S  A  S  V  G  D  R  V  T  I  T  C
INPUT   -  -  -  -  -  -  -  -  -  -  -  -  -  -  -  -  -  -  -  -  -  -  -

_CDR1_____
L15     R  A  S  Q  G  I  S  S  W  L  A  W  Y  Q  Q  K  P  E  K  A  P  K  S
INPUT                .  .  .  .  .  .  .  .           .  .  .  .  .  .  .  .

_CDR2_____
L15     L  I  Y  A  A  S  S  L  Q  S  G  V  P  S  R  F  S  G  S  G  S  G  T
INPUT   -  -  -  -  -  -  -  -  -  -  -  -  -  -  -  -  -  -  -  -  -  -  -

_CDR3_____
L15     D  F  T  L  T  I  S  S  L  Q  P  E  D  F  A  T  Y  Y  C  Q  Q  Y  N
INPUT   -  -  -  -  -  -  -  -  -  -  -  -  -  -  -  -  -  -  -  -  -  -  -

_____
L15     S  Y
JK1                  T  F  G  Q  G  T  K  V  E  I  K
INPUT   -  -  P  P  -  -  -  -  -  -  -  -  -
```

Figure 27

Anti-GITR 19H8 VH (hIgG2)

```
3-33     Q  V  Q  L  V  E  S  G  G  V  V  Q  P  G  R  S  L  R  L  S  C  A
INPUT    -  -  -  -  -  -  -  -  -  -  -  -  -  -  -  -  -  -  -  -  -  -

_CDR1_____
3-33     A  S  G  F  T  F  S  S  Y  G  M  H  W  V  R  Q  A  P  G  K  G  L  E
INPUT    -  -  -  -  -  -  -  N  -  -  -  -  -  -  -  -  -  -  -  -  -  -  -

_CDR2_____
3-33     W  V  A  V  I  W  Y  D  G  S  N  K  Y  Y  A  D  S  V  K  G  R  F  T
INPUT    -  M  -  -  -  -  -  G  -  -  -  -  F  -  -  -  -  -  -  -  -  -  -

3-33     I  S  R  D  N  S  K  N  T  L  Y  L  Q  M  N  S  L  R  A  E  D  T  A
INPUT    -  -  -  -  -  -  -  -  S  -  S  -  -  -  -  -  -  -  -  -  -  -  -

_CDR3_____
3-33     V  Y  Y  C  A  R
3-10                                              Y  Y  Y
JH6                                               Y  Y  Y  G  M  D  V  W  G
INPUT    -  -  -  -  -  -  G  G  A  M  V  R  G  V  -  -  -  -  -  -  -  -

JH6      Q  G  T  T  V  T  V  S  S
INPUT    -  -  -  -  -  -  -  -  -
```

Figure 28

Anti-GITR 19H8 VK1 (hKappa)

```
L18      A  I  Q  L  T  Q  S  P  S  S  L  S  A  S  V  G  D  R  V  T  I  T  C
INPUT    -  -  -  -  -  -  -  -  -  -  -  -  -  -  -  -  -  -  -  -  -  -  -

_CDR1_____
L18      R  A  S  Q  G  I  S  S  A  L  A  W  Y  Q  Q  K  P  G  K  A  P  K  L
INPUT    -  -  -  -  -  -  -  -  -  -  -  -  -  -  -  -  -  -  -  -  -  -  F

_CDR2_____
L18      L  I  Y  D  A  S  S  L  E  S  G  V  P  S  R  F  S  G  S  G  S  G  T
INPUT    -  -  -  -  -  -  -  -  -  -  -  -  -  -  -  -  -  -  -  -  -  -  -

_CDR3_____
L18      D  F  T  L  T  I  S  S  L  Q  P  E  D  F  A  T  Y  Y  C  Q  Q  F  N
INPUT    -  -  -  -  -  -  -  -  -  -  -  -  -  -  -  -  -  -  -  -  -  -  -

_____
L18      N  Y
JK1                  T  F  G  Q  G  T  K  V  E  I  K
INPUT    S  -  P  Q  -  -  -  -  -  -  -  -  -  -
```

Figure 29A

Anti-GITR 19H8 VK2 (hKappa)

```
L6      E  I  V  L  T  Q  S  P  A  T  L  S  L  S  P  G  E  R  A  T  L  S  C
INPUT   -  -  -  -  -  -  -  -  -  -  -  -  -  -  -  -  -  -  -  -  -  -  -

_CDR1_____
L6      R  A  S  Q  S  V  S  S  Y  L  A  W  Y  Q  Q  K  P  G  Q  A  P  R  L
INPUT   -  -  -  -  -  -  -  -  -  -  -  -  -  -  -  -  -  -  -  -  -  -  -

_CDR2_____
L6      L  I  Y  D  A  S  N  R  A  T  G  I  P  A  R  F  S  G  S  G  S  G  T
INPUT   -  -  -  -  -  -  -  -  -  -  -  -  -  -  -  -  -  -  -  -  -  -  -

_CDR3_____
L6      D  F  T  L  T  I  S  S  L  E  P  E  D  F  A  V  Y  Y  C  Q  Q  R  S
INPUT   -  -  -  -  -  -  -  -  -  -  -  -  -  -  -  -  -  -  -  -  -  -  -

_____
L6      N  W
JK4              L  T  F  G  G  G  T  K  V  E  I  K
INPUT   -  -  P  -  -  -  -  -  -  -  -  -  -  -  -
```

Figure 29B

Anti-GITR 6G10 VH (hIgG2)

```
3-33    Q  V  Q  L  V  E  S  G  G  G  V  V  Q  P  G  R  S  L  R  L  S  C  A
INPUT   -  -  -  -  -  -  -  -  -  D  -  -  -  -  -  -  -  -  -  -  -  -  -

_CDR1_____
3-33    A  S  G  F  T  F  S  S  Y  G  M  H  W  V  R  Q  A  P  G  K  G  L  E
INPUT   -  -  -  -  -  -  -  T  -  -  -  -  -  -  -  -  -  -  -  -  -  -  -

_CDR2_____
3-33    W  V  A  V  I  W  Y  D  G  S  N  K  Y  Y  A  D  S  V  K  G  R  F  T
INPUT   -  -  -  -  T  -  -  A  -  -  -  -  F  -  -  -  -  -  -  -  -  -  -

3-33    I  S  R  D  N  S  K  N  T  L  Y  L  Q  M  N  S  L  R  A  E  D  T  A
INPUT   -  -  -  -  -  -  -  -  -  -  -  -  -  -  -  -  -  -  -  -  -  -  -

_CDR3_____
3-33    V  Y  Y  C  A  R
3-10                        M  V  R  G
JH6                                           Y  Y  Y  G  M  D  V  W  G
INPUT   -  -  -  -  -  -  G  G  S  -  -  -  L  -  -  -  -  -  -  -  -

JH6     Q  G  T  T  V  T  V  S  S
INPUT   -  -  -  -  -  -  -  -  -
```

Figure 30

Anti-GITR 6G10 VK1 (hKappa)

```
L18     A  I  Q  L  T  Q  S  P  S  S  L  S  A  S  V  G  D  R  V  T  I  T  C
INPUT   -  -  -  -  -  -  -  -  -  -  -  -  -  -  -  -  -  -  -  -  -  -  -

_CDR1_____
L18     R  A  S  Q  G  I  S  S  A  L  A  W  Y  Q  Q  K  P  G  K  A  P  K  L
INPUT   -  -  -  -  -  -  -  -  -  -  -  -  -  -  -  -  -  -  -  -  -  -  -

_CDR2_____
L18     L  I  Y  D  A  S  S  L  E  S  G  V  P  S  R  F  S  G  S  G  S  G  T
INPUT   -  -  -  -  -  -  -  -  -  -  -  -  -  -  -  -  -  -  -  -  -  -  -

_CDR3_____
L18     D  F  T  L  T  I  S  S  L  Q  P  E  D  F  A  T  Y  Y  C  Q  Q  F  N
INPUT   -  -  -  -  -  -  -  -  -  -  -  -  -  -  -  -  -  -  -  -  -  -  -

_____
L18     N  Y
JK2           Y  T  F  G  Q  G  T  K  L  E  I  K
INPUT   S  -  P  -  -  -  -  -  -  -  -  -  -  -
```

Figure 31

¹QRPTGGPCG ¹¹PGRLLLGTGA ²¹DARCCRVHTT ³¹RCCRDYPGEE

Ranking #1                                    Ranking #2

⁴¹CCSEWDCMCV ⁵¹QPEFHCGDPC ⁶¹CTTCRHHPCP ⁷¹PGQGVQSQGK

⁸¹FSFGFQCIDC ⁹¹ASGTFSGGHE ¹⁰¹GHCKPWTDCT ¹¹¹QFGFLTVFPG

¹²¹NKTHNAVCVP ¹³¹GSPPAEIEGR ¹⁴¹MD

Donor 1
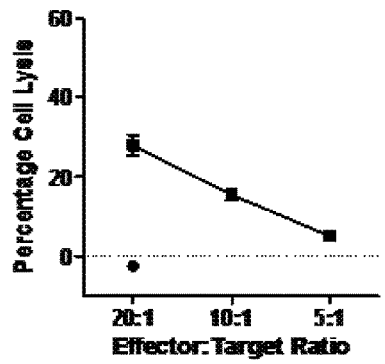
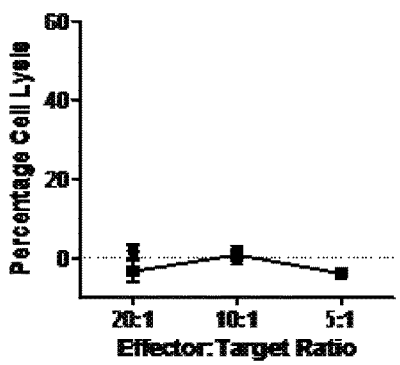
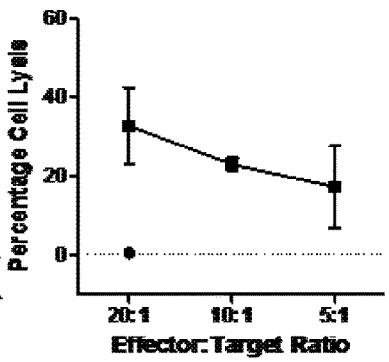
Figure 61A　　　　　　　Figure 61B　　　　　　　Figure 61C
Donor 2
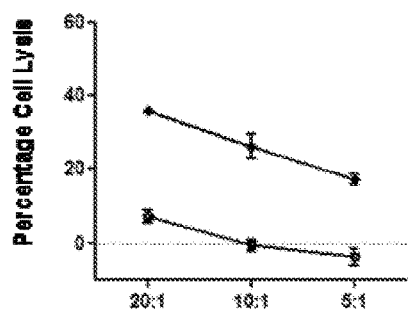
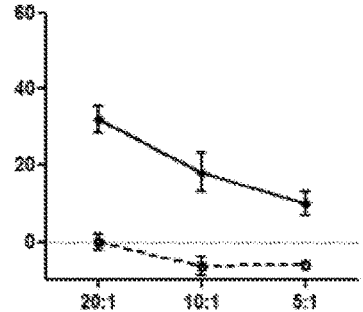
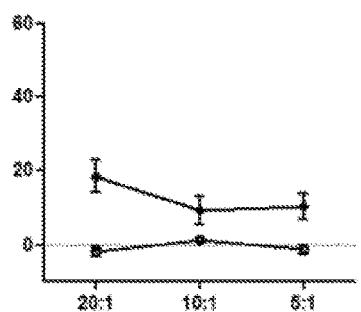
Figure 61D　　　　　　　Figure 61E　　　　　　　Figure 61F

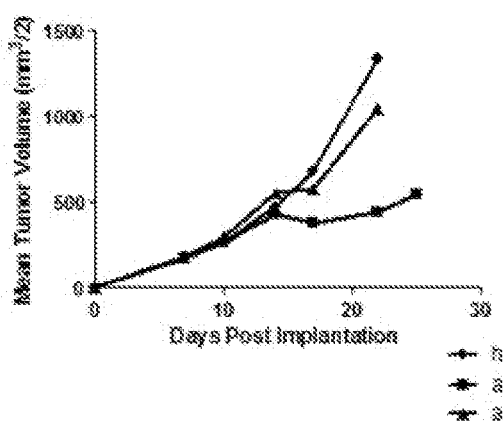
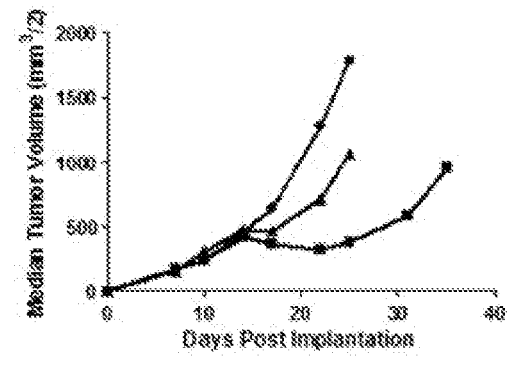
Figure 63A                    Figure 63B

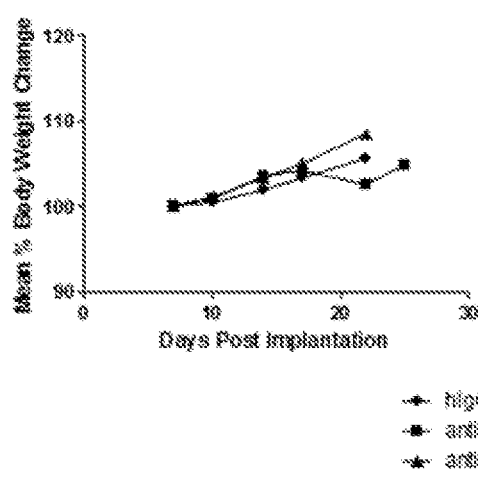
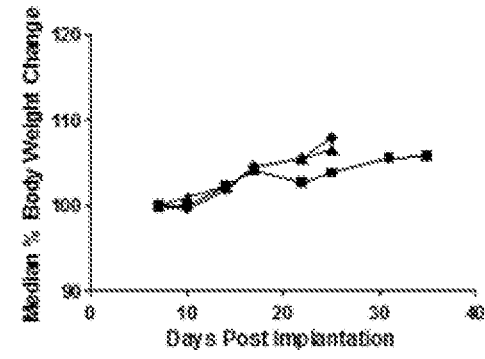
Figure 64A                    Figure 64B

Figure 73A
Figure 73B
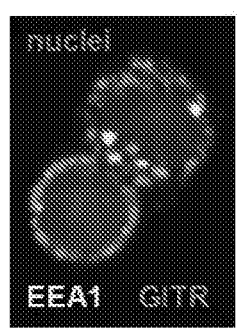
30min
120min
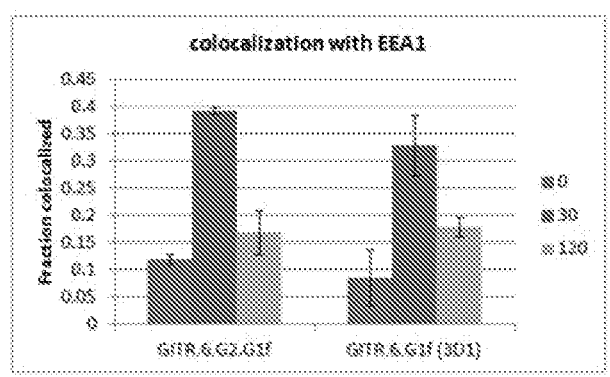
Quantification
$$m_1 = \frac{\sum x_{coloc}}{\sum x}$$
Figure 73C

ANTIBODIES AGAINST GLUCOCORTICOID-INDUCED TUMOR NECROSIS FACTOR RECEPTOR (GITR)

CROSS-REFERENCE TO RELATED APPLICATIONS

This application is a 35 U.S.C. 371 national stage filing of International Application No. PCT/US2016/062540, filed Nov. 17, 2016, which claims priority to U.S. Provisional Application Nos. 62/257,599 and 62/303,990, filed Nov. 19, 2015 and Mar. 4, 2016, respectively. The contents of the aforementioned applications are hereby incorporated by reference.

SEQUENCE LISTING

The instant application contains a Sequence Listing which has been submitted electronically in ASCII format and is hereby incorporated by reference in its entirety. Said ASCII copy, created on May 16, 2018, is named MXI_547US_Sequence_Listing.txt and is 1,011,604 bytes in size.

BACKGROUND

Glucocorticoid-induced TNFR-related protein (GITR), a co-stimulatory molecule also known as TNFRSF18, AITR, CD357, and GITR-D, is a member of the TNF receptor family originally identified in murine T cell lines treated with dexamethasone (Nocentini et al., *PNAS* 1997; 94:6216-21). Other related members of the TNF receptor family include CD40, CD27, 4-1BB, and OX40. Although GITR expression is low in naïve CD4+ and CD8+ cells, it is constitutively expressed in regulatory T cells (Tone et al., *PNAS* 2003; 100:15059-64). However, once its expression is induced on effector T cells, GITR engagement promotes their activation, proliferation, and cytokine production (Watts, *Annual Reviews in Immunology* 2005; 23:23-68). With respect to CD4+CD25+ regulatory T cells (Tregs), Shimizu reported that GITR engagement suppresses their function (Shimizu et al., *Nature Immunology* 2002; 3:135-42) using a mixed culture suppression assay. However, subsequent work by Stephans et al (*JI* 2004 15; 173(8):5008-20) determined that GITR engagement on Teffector ($T_{eff}$) cells renders them less sensitive to Treg supression, accounting for the decreased suppression observed in Treg-$T_{eff}$ cell co-cultures. DTA-1 (rat anti-mouse GITR) antibody-mediated GITR stimulation promotes anti-tumor immunity in multiple tumor models.

GITR-L, the ligand for GITR, is expressed at low levels in antigen-presenting cells (e.g., B cells, dendritic cells), but is transiently upregulated in these cells upon activation, e.g., by viral infection (Suvas et al., *J Virol.* 2005; 79:11935-42).

Given the ongoing need for improved strategies for targeting diseases such as cancer, benefits from enhanced immune responses, in particular, T cell responses, novel agents and methods that modulate GITR activity are highly desirable.

SUMMARY

Provided herein are isolated antibodies, such as monoclonal antibodies, in particular human monoclonal antibodies, that specifically bind GITR and have desirable functional properties. These properties include high affinity binding to human GITR, binding to monkey GITR (e.g., cynomolgus GITR), and the ability to stimulate antigen-specific T cell responses. The antibodies described herein can be used to stimulate antigen-specific T cell responses, such as in a tumor-bearing or virus-bearing (virus-infected) subject, and to detect GITR protein in a sample.

In one aspect, provided herein are isolated antibodies, or antigen binding portions thereof, which bind to GITR and comprise a heavy chain constant region comprising (1) an amino acid sequence selected from the group consisting of SEQ ID NOs: 223-226, 283-290, 383-446 and 480-543 or (2) a heavy chain constant region that differs therefrom in at most 5 amino acids or is at least 95%, 96%, 97%, 98% or 99% identical to an amino acid sequence of SEQ ID NOs: 223-226, 283-290, 383-446 and 480-543, wherein the amino acid modification(s) are not at the specific amino acid(s) in SEQ ID NOs: 223-226, 283-290, 383-446 and 480-543 that are not present in the naturally-occurring human heavy chain constant regions. In certain embodiments, the antibodies exhibit at least one of the following properties:

(a) binding to soluble human GITR;
(b) binding to membrane bound human GITR;
(c) binding to membrane bound cynomolgus GITR;
(d) inducing or enhancing T cell activation, e.g., antigen specific T cell activation;
(e) inhibiting the binding of GITR ligand to GITR on 3A9-hGITR cells;
(f) at most partially inhibiting the binding of GITR ligand to GITR on activated T cells;
(g) binding to a conformational epitope on mature human GITR (SEQ ID NO: 4);
(h) binding to both O-linked and N-glycosylated and unglycosylated human GITR;
(i) having agonist activity in the absence of binding to an Fc receptor, but wherein binding to an Fc receptor further enhances the agonist activity; and
(j) competing in either direction or both directions for binding to human GITR with one or more of antibodies 28F3, 3C3-1, 3C3-2, 2G6, 8A6, 9G7-1, 9G7-2, 14E3, 19H8-1, 19H8-2, 19D3, 18E10, and 6G10.

In certain embodiments, the anti-GITR antibodies, or antigen binding portions thereof, described herein stimulate an anti-tumor immune response, for example, an antigen-specific T cell response. In certain embodiments, the anti-GITR antibodies, or antigen binding portions thereof, increase cytokine production (e.g., IL-2 and/or IFN-γ) in GITR-expressing T cells and/or increase T cell proliferation.

In certain embodiments, the anti-GITR antibodies, or antigen binding portions thereof, do not bind to Fc receptors. In certain embodiments, the anti-GITR antibodies, or antigen binding portions thereof, bind to one or more FcγRs, e.g., activating or inhibitory, FcγRs.

In certain embodiments, the anti-GITR antibodies, or antigen binding portions thereof, bind to soluble human GITR with a $K_D$ of 10 nM or less as measured by Biacore, bind to membrane bound human GITR with a $K_D$ of 1 nM or less as measured by Scatchard, bind to membrane bound human GITR with an $EC_{50}$ of 1 nM or less as measured by FACS, bind to membrane bound cynomolgus GITR with an $EC_{50}$ of 10 nM or less as measured by FACS, induce or enhance T cell, e.g., $T_{eff}$ cell, activation without requiring multivalent cross-linking, inhibit the binding of GITR ligand to GITR with an $EC_{50}$ of 1 µg/mL or less as measured by FACS, and/or bind within the regions PTGGPGCGPGRLLLGTGT (SEQ ID NO: 217) and CRDYPGEE (SEQ ID NO: 218) of mature human GITR (SEQ ID NO: 4).

Provided herein are isolated monoclonal antibodies, or antigen binding portions thereof, which specifically bind to GITR and comprise the three variable heavy chain CDRs and the three variable light chain CDRs that are in the variable heavy chain and variable light chain pairs selected from:

(a) SEQ ID NOs: 13 and 14;
(b) SEQ ID NOs: 26 and 27;
(c) SEQ ID NOs: 39 and 40;
(d) SEQ ID NOs: 52 and 53;
(e) SEQ ID NOs: 52 and 54;
(f) SEQ ID NOs: 71 and 72;
(g) SEQ ID NOs: 84 and 85;
(h) SEQ ID NOs: 97 and 98;
(i) SEQ ID NOs: 97 and 99;
(j) SEQ ID NOs: 115 and 116;
(k) SEQ ID NOs: 128 and 129;
(l) SEQ ID NOs: 128 and 130; and
(m) SEQ ID NOs: 335 and 336, and
comprise a heavy chain constant region comprising (1) an amino acid sequence selected from the group consisting of SEQ ID NOs: 223-226, 283-290, 383-446 and 480-543 or (2) a heavy chain constant region that differs therefrom in at most 5 amino acids or is at least 95%, 96%, 97%, 98% or 99% identical to an amino acid sequence of SEQ ID NOs: 223-226, 283-290, 383-446 and 480-543, wherein the amino acid modification(s) are not at the specific amino acid(s) in SEQ ID NOs: 223-226, 283-290, 383-446 and 480-543 that are not present in the naturally-occurring human heavy chain constant regions.

Provided herein are isolated monoclonal antibodies, or antigen binding portions thereof, which bind to GITR and comprise:

(a) heavy chain CDR1, CDR2, and CDR3 sequences comprising SEQ ID NOs: 20, 21, and 22, respectively, and/or light chain CDR1, CDR2, and CDR3 sequences comprising SEQ ID NOs: 23, 24, and 25, respectively;

(b) heavy chain CDR1, CDR2, and CDR3 sequences comprising SEQ ID NOs: 33, 34, and 35, respectively, and/or light chain CDR1, CDR2, and CDR3 sequences comprising SEQ ID NOs: 36, 37, and 38, respectively; or (c) heavy chain CDR1, CDR2, and CDR3 sequences comprising SEQ ID NOs: 46, 47, and 48, respectively, and/or light chain CDR1, CDR2, and CDR3 sequences comprising SEQ ID NOs: 49, 50, and 51, respectively;

(d) heavy chain CDR1, CDR2, and CDR3 sequences comprising SEQ ID NOs: 62, 63, and 64, respectively, and/or light chain CDR1, CDR2, and CDR3 sequences comprising SEQ ID NOs: 65, 66, and 67, respectively;

(e) heavy chain CDR1, CDR2, and CDR3 sequences comprising SEQ ID NOs: 62, 63, and 64, respectively, and/or light chain CDR1, CDR2, and CDR3 sequences comprising SEQ ID NOs: 68, 69, and 70, respectively;

(f) heavy chain CDR1, CDR2, and CDR3 sequences comprising SEQ ID NOs: 78, 79, and 80, respectively, and/or light chain CDR1, CDR2, and CDR3 sequences comprising SEQ ID NOs: 81, 82, and 83, respectively;

(g) heavy chain CDR1, CDR2, and CDR3 sequences comprising SEQ ID NOs: 91, 92, and 93, respectively, and/or light chain CDR1, CDR2, and CDR3 sequences comprising SEQ ID NOs: 94, 95, and 96, respectively;

(h) heavy chain CDR1, CDR2, and CDR3 sequences comprising SEQ ID NOs: 106, 107, and 108, respectively, and/or light chain CDR1, CDR2, and CDR3 sequences comprising SEQ ID NOs: 109, 110, and 111, respectively;

(i) heavy chain CDR1, CDR2, and CDR3 sequences comprising SEQ ID NOs: 106, 107, and 108, respectively, and/or light chain CDR1, CDR2, and CDR3 sequences comprising SEQ ID NOs: 112, 113, and 114, respectively;

(j) heavy chain CDR1, CDR2, and CDR3 sequences comprising SEQ ID NOs: 122, 123, and 124, respectively, and/or light chain CDR1, CDR2, and CDR3 sequences comprising SEQ ID NOs: 125, 126, and 127, respectively;

(k) heavy chain CDR1, CDR2, and CDR3 sequences comprising SEQ ID NOs: 138, 139, and 140, respectively, and/or light chain CDR1, CDR2, and CDR3 sequences comprising SEQ ID NOs: 141, 142, and 143, respectively;

(l) heavy chain CDR1, CDR2, and CDR3 sequences comprising SEQ ID NOs: 138, 139, and 140, respectively, and/or light chain CDR1, CDR2, and CDR3 sequences comprising SEQ ID NOs: 144, 145, and 146, respectively; or (m) heavy chain CDR1, CDR2, and CDR3 sequences comprising SEQ ID NOs: 342, 343, and 344, respectively, and/or light chain CDR1, CDR2, and CDR3 sequences comprising SEQ ID NOs: 345, 346, and 347, respectively, and comprise a heavy chain constant region comprising (1) an amino acid sequence selected from the group consisting of SEQ ID NOs: 223-226, 283-290, 383-446 and 480-543 or (2) a heavy chain constant region that differs therefrom in at most 5 amino acids or is at least 95%, 96%, 97%, 98% or 99% identical to an amino acid sequence of SEQ ID NOs: 223-226, 283-290, 383-446 and 480-543, wherein the amino acid modification(s) are not at the specific amino acid(s) in SEQ ID NOs: 223-226, 283-290, 383-446 and 480-543 that are not present in the naturally-occurring human heavy chain constant regions.

Provided herein are isolated monoclonal antibodies, or antigen binding portions thereof, which bind to GITR and comprise heavy and light chain variable regions, wherein the heavy chain variable region comprises an amino acid sequence which is at least 90%, 95%, 96%, 97%, 98%, 99%, or 100% identical to the amino acid sequence selected from the group consisting of SEQ ID NOs: 13, 26, 39, 52, 71, 84, 97, 115, 128, and 335.

Provided herein are isolated monoclonal antibodies, or antigen binding portions thereof, which bind to GITR and comprise heavy and light chain variable regions, wherein the light chain variable region comprises an amino acid sequence which is at least 90%, 95%, 96%, 97%, 98%, 99%, or 100% identical to the amino acid sequence selected from the group consisting of SEQ ID NOs: 14, 27, 40, 53, 54, 72, 85, 98, 99, 116, 129, 130, and 336.

Provided herein are isolated monoclonal antibodies, or antigen binding portions thereof, which bind to GITR and comprise heavy and light chain variable region sequences at least 85% identical, for example, 90%, 95%, 96%, 97%, 98%, 99%, or 100% identical, to the amino acid sequences selected from the group consisting of:

(a) SEQ ID NOs: 13 and 14, respectively;
(b) SEQ ID NOs: 26 and 27, respectively;
(c) SEQ ID NOs: 39 and 40, respectively;
(d) SEQ ID NOs: 52 and 53, respectively;
(e) SEQ ID NOs: 52 and 54, respectively;
(f) SEQ ID NOs: 71 and 72, respectively;
(g) SEQ ID NOs: 84 and 85, respectively;
(h) SEQ ID NOs: 97 and 98, respectively;
(i) SEQ ID NOs: 97 and 99, respectively;
(j) SEQ ID NOs: 115 and 116, respectively;
(k) SEQ ID NOs: 128 and 129, respectively;
(l) SEQ ID NOs: 128 and 130, respectively; and
(m) SEQ ID NOs: 335 and 336, respectively.

Provided herein are isolated monoclonal antibodies, or antigen binding portions thereof, which bind to GITR and comprise heavy chain and light chain sequences at least 80%, 85%, 90%, 95%, 96%, 97%, 98% 99%, or 100% identical to the amino acid sequences selected from the group consisting of:
(a) SEQ ID NOs: 15 and 16, respectively;
(b) SEQ ID NOs: 17 and 19, respectively;
(c) SEQ ID NOs: 18 and 19, respectively;
(d) SEQ ID NOs: 28 and 29, respectively;
(e) SEQ ID NOs: 30 and 32, respectively;
(f) SEQ ID NOs: 31 and 32, respectively;
(g) SEQ ID NOs: 41 and 42, respectively;
(h) SEQ ID NOs: 43 and 45, respectively;
(i) SEQ ID NOs: 44 and 45, respectively;
(j) SEQ ID NOs: 55 and 56, respectively;
(k) SEQ ID NOs: 55 and 57, respectively;
(l) SEQ ID NOs: 58 and 60, respectively;
(m) SEQ ID NOs: 59 and 60, respectively;
(n) SEQ ID NOs: 58 and 61, respectively;
(o) SEQ ID NOs: 59 and 61, respectively;
(p) SEQ ID NOs: 73 and 74, respectively;
(q) SEQ ID NOs: 75 and 77, respectively;
(r) SEQ ID NOs: 76 and 77, respectively;
(s) SEQ ID NOs: 86 and 87, respectively;
(t) SEQ ID NOs: 88 and 90, respectively;
(u) SEQ ID NOs: 89 and 90, respectively;
(v) SEQ ID NOs: 102 and 104, respectively;
(w) SEQ ID NOs: 103 and 104, respectively;
(x) SEQ ID NOs: 100 and 101, respectively;
(y) SEQ ID NOs: 100 and 371, respectively;
(z) SEQ ID NOs: 102 and 105, respectively;
(za) SEQ ID NOs: 103 and 105, respectively;
(zb) SEQ ID NOs: 117 and 118, respectively;
(zc) SEQ ID NOs: 119 and 121, respectively;
(zd) SEQ ID NOs: 120 and 121, respectively;
(ze) SEQ ID NOs: 131 and 132, respectively;
(zf) SEQ ID NOs: 134 and 136, respectively;
(zg) SEQ ID NOs: 135 and 136, respectively;
(zh) SEQ ID NOs: 131 and 133, respectively;
(zi) SEQ ID NOs: 134 and 137, respectively;
(zj) SEQ ID NOs: 135 and 137, respectively
(zk) SEQ ID NOs: 337 and 338, respectively;
(zl) SEQ ID NOs: 339 and 341, respectively; and
(zm) SEQ ID NOs: 340 and 341, respectively.

In certain embodiments, the isolated monoclonal antibodies, or antigen binding portions thereof, (a) bind to the same epitope on GITR as 28F3, 19D3, 18E10, 3C3-1, 3C3-2, 2G6, 9G7-1, 9G7-2, 14E3, 19H8-1, 19H8-2 and/or 6G10, and (b) inhibit binding of 28F3, 19D3, 18E10, 3C3-1, 3C3-2, 2G6, 9G7-1, 9G7-2, 14E3, 19H8-1, 19H8-2, and/or 6G10 to GITR on activated T cells by at least 50%, 60%, 70%, 80% or 90% as measured by, e.g., FACS.

In certain embodiments, the anti-GITR antibodies, or antigen binding portions thereof, bind within the regions PTGGPGCGPGRLLLGTGT (SEQ ID NO: 217) and CRDYPGEE (SEQ ID NO: 218) of mature human GITR (SEQ ID NO: 4). In some embodiments, the anti-GITR antibodies, or antigen binding portions thereof, described herein, bind to both human and cynomolgus GITR.

In certain embodiments, the anti-GITR antibodies, or antigen-binding portions thereof, are IgG1, IgG2, IgG3, or IgG4 antibodies, or variants thereof. In certain embodiments, the anti-GITR antibodies, or antigen-binding portions thereof, comprise an effectorless IgG1 Fc, for example, an effectorless IgG1 Fc with the following mutations: L234A, L235E, G237A, A330S and P331S. In certain embodiments, the anti-GITR antibodies, or antigen-binding portions thereof, comprise an Fc binding to, or having enhanced binding to, an activating FcγR, e.g., relative to a wild-type IgG1 Fc. In certain embodiments, methionine residues in the CDR regions of the anti-GITR antibodies, or antigen-binding portions thereof, are substituted for amino acid residues that do not undergo oxidation. In certain embodiments, the anti-GITR antibodies, or antigen-binding portions thereof, are human or humanized antibodies.

Provided herein are isolated monoclonal antibodies, or antigen binding portions thereof, which bind to GITR comprising a modified heavy chain constant region that comprises an IgG2 hinge and at least one of CH1, CH2 and CH3 that is not of an IgG2 isotype, wherein the anti-GITR antibody has enhanced agonist activity relative to the same anti-GITR antibody but with a non-IgG2 hinge.

In certain embodiments, the modified heavy chain constant region comprises a heavy chain constant region comprising an amino acid sequence selected from the group consisting of SEQ ID NOs: 223-226, 283-290, 383-446 and 480-543 or a heavy chain constant region that differs therefrom in at most 5 amino acids or is at least 95%, 96%, 97%, 98% or 99% identical to an amino acid sequence of SEQ ID NOs: 223-226, 283-290, 383-446 and 480-543.

In certain embodiments, the heavy chain comprises an amino acid sequence selected from the group consisting of SEQ ID NOs: 15, 17, 18, 28, 30, 31, 41, 43, 44, 55, 58, 59, 73, 75, 76, 86, 88, 89, 100, 102, 103, 117, 119, 120, 131, 134, 135, 227-275, 337, 339, 340, 348-352, 361, and 362, or a heavy chain that differs therefrom in at most 10 amino acids or is at least 95%, 96%, 97%, 98% or 99% identical to an amino acid sequence of SEQ ID NOs: 15, 17, 18, 28, 30, 31, 41, 43, 44, 55, 58, 59, 73, 75, 76, 86, 88, 89, 100, 102, 103, 117, 119, 120, 131, 134, 135, 227-275, 337, 339, 340, 348-352, 361, and 362.

In certain embodiments, the light chain comprises an amino acid sequence selected from the group consisting of SEQ ID NOs: 16, 19, 29, 32, 42, 45, 56, 57, 60, 61, 74, 87, 90, 101, 104, 105, 118, 121, 132, 133, 136, 137, 338, 341, and 371 or a light chain that differs therefrom in at most 10 amino acids or is at least 95%, 96%, 97%, 98% or 99% identical to an amino acid sequence of SEQ ID NOs: 16, 19, 29, 32, 42, 45, 56, 57, 60, 61, 74, 87, 90, 101, 104, 105, 118, 121, 132, 133, 136, 137, 338, 341, and 371.

Provided herein are bispecific molecules comprising an anti-GITR antibody linked to a molecule having a second binding specificity.

Provided herein are nucleic acids encoding the heavy and/or light chain variable regions of the anti-GITR antibodies, or antigen binding portions thereof, expression vectors comprising the nucleic acid molecules, and cells transformed with the expression vectors.

Provided herein are immunoconjugates comprising the anti-GITR antibodies described herein, linked to an agent.

Provided herein are compositions comprising anti-GITR antibodies, or antigen binding portions thereof, and a carrier. Also provided herein are kits comprising the anti-GITR antibodies, or antigen binding portions thereof, and instructions for use.

Provided herein is a method of preparing the anti-GITR antibodies, comprising expressing an anti-GITR antibody in a cell and isolating the antibody from the cell.

Provided herein is a method of stimulating an antigen-specific T cell response comprising contacting the T cell with an anti-GITR antibody, or antigen binding portion thereof, such that an antigen-specific T cell response is stimulated.

Provided herein is a method of activating or co-stimulating a T cell, e.g., an effector T cell, comprising contacting a cell, e.g., an effector T cell, with an anti-GITR antibody, or antigen binding portion thereof, and CD3, wherein the effector T cell is activated or co-stimulated.

Provided herein is a method of increasing IL-2 and/or IFN-γ production in and/or proliferation of a T cell comprising contacting the T cell with an effective amount of an anti-GITR antibody, or antigen binding portion thereof.

Provided herein is a method of increasing IL-2 and/or IFN-γ production in T cells in a subject comprising administering an effective amount of an anti-GITR antibody, or antigen binding portion thereof, bispecific molecule or conjugate comprising the anti-GITR antibody, or composition comprising the anti-GITR antibody, to increase IL-2 and/or IFN-γ production from the T cells.

Provided herein is a method of reducing or depleting the number of T regulatory cells in a tumor of a subject in need thereof comprising administering an effective amount of an anti-GITR antibody, or antigen binding portion thereof, bispecific molecule or conjugate wherein the antibody, or antigen binding portion thereof, has effector or enhanced effector function, to reduce the number of T regulatory cells in the tumor.

Provided herein is a method of stimulating an immune response in a subject comprising administering an effective amount of an anti-GITR antibody, or antigen binding portion thereof, bispecific molecule or conjugate to the subject such that an immune response in the subject is stimulated. In certain embodiments, the subject has a tumor and an immune response against the tumor is stimulated.

Provided herein is a method of inhibiting the growth of tumor cells in a subject comprising administering to the subject an anti-GITR antibody, or antigen binding portion thereof, bispecific molecule or conjugate such that growth of the tumor is inhibited in the subject.

Provided herein is a method of treating cancer, e.g., by immunotherapy, comprising administering to a subject in need thereof a therapeutically effective amount an anti-GITR antibody, or antigen binding portion thereof, bispecific molecule or conjugate comprising the anti-GITR antibody, or composition comprising the anti-GITR antibody, to treat the cancer. In certain embodiments, the cancer is bladder cancer, breast cancer, uterine/cervical cancer, ovarian cancer, prostate cancer, testicular cancer, esophageal cancer, gastrointestinal cancer, pancreatic cancer, colorectal cancer, colon cancer, kidney cancer, head and neck cancer, lung cancer, stomach cancer, germ cell cancer, bone cancer, liver cancer, thyroid cancer, skin cancer, neoplasm of the central nervous system, lymphoma, leukemia, myeloma, sarcoma, and virus-related cancer. In certain embodiments, the cancer is a metastatic cancer, refractory cancer, or recurrent cancer.

In certain embodiments, the methods described herein further comprise administering one or more additional therapeutics with a anti-GITR antibody, for example, an anti-PD1 antibody, a LAG-3 antibody, a CTLA-4 antibody, and/or a PD-L1 antibody.

Provided herein is a method of detecting the presence of GITR in a sample comprising contacting the sample with an anti-GITR antibody, or an antigen binding portion thereof, under conditions that allow for formation of a complex between the antibody, or antigen binding portion thereof, and GITR, and detecting the formation of a complex.

Provided herein are uses of the anti-GITR antibodies described herein for treating cancer, stimulating an immune response in a subject, stimulating an antigen-specific T cell response, activating or co-stimulating a T cell, increasing IL-2 and/or IFN-γ production in and/or proliferation of a T cell, reducing or depleting the number of T regulatory cells in a tumor, and/or inhibiting the growth of tumor cells. Also provided herein are uses of the anti-GITR antibodies described herein for preparing a medicament for stimulating an immune response in a subject, stimulating an antigen-specific T cell response, activating or co-stimulating a T cell, increasing IL-2 and/or IFN-γ production in and/or proliferation of a T cell, reducing or depleting the number of T regulatory cells in a tumor, and/or inhibiting the growth of tumor cells.

Other features and advantages of the instant disclosure will be apparent from the following detailed description and examples, which should not be construed as limiting.

BRIEF DESCRIPTION OF THE DRAWINGS

FIG. 1 shows the amino acid sequences of the heavy and light chain variable regions of monoclonal antibodies 28F3 (SEQ ID NO: 13 and 14, respectively), 18E10 (SEQ ID NO: 39 and 40, respectively), and 19D3 (SEQ ID NO: 26 and 27, respectively). The VH and VL CDRs of 28F3 are underlined.

FIG. 2A shows the nucleotide sequence (SEQ ID NO: 147) and amino acid sequence (SEQ ID NO: 13) of the heavy chain variable region of the 28F3 human monoclonal antibody. The CDR1 (SEQ ID NO: 20), CDR2 (SEQ ID NO: 21) and CDR3 (SEQ ID NO: 22) regions are delineated and the V, D and J germline derivations are indicated.

FIG. 2B shows the nucleotide sequence (SEQ ID NO: 148) and amino acid sequence (SEQ ID NO: 14) of the kappa light chain variable region of the 28F3 human monoclonal antibody. The CDR1 (SEQ ID NO: 23), CDR2 (SEQ ID NO: 24) and CDR3 (SEQ ID NO: 25) regions are delineated and the V and J germline derivations are indicated.

FIG. 3A shows the nucleotide sequence (SEQ ID NO: 158) and amino acid sequence (SEQ ID NO: 39) of the heavy chain variable region of the 18E10 human monoclonal antibody. The CDR1 (SEQ ID NO: 46), CDR2 (SEQ ID NO: 47) and CDR3 (SEQ ID NO: 48) regions are delineated and the V, D and J germline derivations are indicated.

FIG. 3B shows the nucleotide sequence (SEQ ID NO: 159) and amino acid sequence (SEQ ID NO: 40) of the kappa light chain variable region of the 18E10 human monoclonal antibody. The CDR1 (SEQ ID NO: 49), CDR2 (SEQ ID NO: 50) and CDR3 (SEQ ID NO: 51) regions are delineated and the V and J germline derivations are indicated.

FIG. 4A shows the nucleotide sequence (SEQ ID NO: 154) and amino acid sequence (SEQ ID NO: 26) of the heavy chain variable region of the 19D3 human monoclonal antibody. The CDR1 (SEQ ID NO: 33), CDR2 (SEQ ID NO: 34) and CDR3 (SEQ ID NO: 35) regions are delineated and the V, D and J germline derivations are indicated.

FIG. 4B shows the nucleotide sequence (SEQ ID NO: 155) and amino acid sequence (SEQ ID NO: 27) of the kappa light chain variable region of the 19D3 human monoclonal antibody. The CDR1 (SEQ ID NO: 36), CDR2 (SEQ ID NO: 37) and CDR3 (SEQ ID NO: 38) regions are delineated and the V and J germline derivations are indicated.

FIG. 5A shows the nucleotide sequence (SEQ ID NO: 162) and amino acid sequence (SEQ ID NO: 52) of the heavy chain variable region of the 3C3 human monoclonal antibody. The CDR1 (SEQ ID NO: 62), CDR2 (SEQ ID NO: 63) and CDR3 (SEQ ID NO: 64) regions are delineated and the V, D and J germline derivations are indicated.

FIG. 5B shows the nucleotide sequence (SEQ ID NO: 163) and amino acid sequence (SEQ ID NO: 53) of the kappa light chain variable region (VK1) of the 3C3 human monoclonal antibody. The CDR1 (SEQ ID NO: 65), CDR2 (SEQ ID NO: 66) and CDR3 (SEQ ID NO: 67) regions are delineated and the V and J germline derivations are indicated.

FIG. 5C shows the nucleotide sequence (SEQ ID NO: 164) and amino acid sequence (SEQ ID NO: 54) of the kappa light chain variable region (VK2) of the 3C3 human monoclonal antibody. The CDR1 (SEQ ID NO: 68), CDR2 (SEQ ID NO: 69) and CDR3 (SEQ ID NO: 70) regions are delineated and the V and J germline derivations are indicated.

FIG. 6A shows the nucleotide sequence (SEQ ID NO: 168) and amino acid sequence (SEQ ID NO: 71) of the heavy chain variable region of the 2G6 human monoclonal antibody. The CDR1 (SEQ ID NO: 78), CDR2 (SEQ ID NO: 79) and CDR3 (SEQ ID NO: 80) regions are delineated and the V, D and J germline derivations are indicated.

FIG. 6B shows the nucleotide sequence (SEQ ID NO: 169) and amino acid sequence (SEQ ID NO: 72) of the kappa light chain variable region of the 2G6 human monoclonal antibody. The CDR1 (SEQ ID NO: 81), CDR2 (SEQ ID NO: 82) and CDR3 (SEQ ID NO: 83) regions are delineated and the V and J germline derivations are indicated.

FIG. 7A shows the nucleotide sequence (SEQ ID NO: 172) and amino acid sequence (SEQ ID NO: 84) of the heavy chain variable region of the 8A6 human monoclonal antibody. The CDR1 (SEQ ID NO: 91), CDR2 (SEQ ID NO: 92) and CDR3 (SEQ ID NO: 93) regions are delineated and the V, D and J germline derivations are indicated.

FIG. 7B shows the nucleotide sequence (SEQ ID NO: 173) and amino acid sequence (SEQ ID NO: 85) of the kappa light chain variable region of the 8A6 human monoclonal antibody. The CDR1 (SEQ ID NO: 94), CDR2 (SEQ ID NO: 95) and CDR3 (SEQ ID NO: 96) regions are delineated and the V and J germline derivations are indicated.

FIG. 8A shows the nucleotide sequence (SEQ ID NO: 176) and amino acid sequence (SEQ ID NO: 97) of the heavy chain variable region of the 9G7 human monoclonal antibody. The CDR1 (SEQ ID NO: 106), CDR2 (SEQ ID NO: 107) and CDR3 (SEQ ID NO: 108) regions are delineated and the V, D and J germline derivations are indicated.

FIG. 8B shows the nucleotide sequence (SEQ ID NO: 177) and amino acid sequence (SEQ ID NO: 98) of the kappa light chain variable region (VK1) of the 9G7 human monoclonal antibody. The CDR1 (SEQ ID NO: 109), CDR2 (SEQ ID NO: 110) and CDR3 (SEQ ID NO: 111) regions are delineated and the V and J germline derivations are indicated.

FIG. 8C shows the nucleotide sequence (SEQ ID NO: 178) and amino acid sequence (SEQ ID NO: 99) of the kappa light chain variable region (VK2) of the 9G7 human monoclonal antibody. The CDR1 (SEQ ID NO: 112), CDR2 (SEQ ID NO: 113) and CDR3 (SEQ ID NO: 114) regions are delineated and the V and J germline derivations are indicated.

FIG. 9A shows the nucleotide sequence (SEQ ID NO: 182) and amino acid sequence (SEQ ID NO: 115) of the heavy chain variable region of the 14E3 human monoclonal antibody. The CDR1 (SEQ ID NO: 122), CDR2 (SEQ ID NO: 123) and CDR3 (SEQ ID NO: 124) regions are delineated and the V, D and J germline derivations are indicated.

FIG. 9B shows the nucleotide sequence (SEQ ID NO: 183) and amino acid sequence (SEQ ID NO: 116) of the kappa light chain variable region of the 14E3 human monoclonal antibody. The CDR1 (SEQ ID NO: 125), CDR2 (SEQ ID NO: 126) and CDR3 (SEQ ID NO: 127) regions are delineated and the V and J germline derivations are indicated.

FIG. 10A shows the nucleotide sequence (SEQ ID NO: 186) and amino acid sequence (SEQ ID NO: 128) of the heavy chain variable region of the 19H8 human monoclonal antibody. The CDR1 (SEQ ID NO: 138), CDR2 (SEQ ID NO: 139) and CDR3 (SEQ ID NO: 140) regions are delineated and the V, D and J germline derivations are indicated.

FIG. 10B shows the nucleotide sequence (SEQ ID NO: 187) and amino acid sequence (SEQ ID NO: 129) of the kappa light chain variable region (VK1) of the 19H8 human monoclonal antibody. The CDR1 (SEQ ID NO: 141), CDR2 (SEQ ID NO: 142) and CDR3 (SEQ ID NO: 143) regions are delineated and the V and J germline derivations are indicated.

FIG. 10C shows the nucleotide sequence (SEQ ID NO: 188) and amino acid sequence (SEQ ID NO: 130) of the kappa light chain variable region (VK2) of the 19H8 human monoclonal antibody. The CDR1 (SEQ ID NO: 144), CDR2 (SEQ ID NO: 145) and CDR3 (SEQ ID NO: 146) regions are delineated and the V and J germline derivations are indicated.

FIG. 11A shows the nucleotide sequence (SEQ ID NO: 353) and amino acid sequence (SEQ ID NO: 335) of the heavy chain variable region of the 6G10 human monoclonal antibody. The CDR1 (SEQ ID NO: 342), CDR2 (SEQ ID NO: 343) and CDR3 (SEQ ID NO: 344) regions are delineated and the V, D and J germline derivations are indicated.

FIG. 11B shows the nucleotide sequence (SEQ ID NO: 354) and amino acid sequence (SEQ ID NO: 336) of the kappa light chain variable region of the 6G10 human monoclonal antibody. The CDR1 (SEQ ID NO: 345), CDR2 (SEQ ID NO: 346) and CDR3 (SEQ ID NO: 347) regions are delineated and the V and J germline derivations are indicated.

FIG. 12 shows an alignment of the amino acid sequence of the heavy chain variable regions of 28F3 (SEQ ID NO: 13) with the human germline $V_H$ 3-33, 3-10 and JH6 amino acid sequences (SEQ ID NOs: 192, 193, and 196, respectively).

FIG. 13 shows an alignment of the amino acid sequence of the light chain variable region of 28F3 (SEQ ID NO: 14) with the human germline $V_k$ L18 and JK2 amino acid sequences (SEQ ID NOs: 204 and 205, respectively).

FIG. 14 shows an alignment of the amino acid sequence of the heavy chain variable regions of 18E10 (SEQ ID NO: 39) with the human germline $V_H$ 3-33, 6-19, and JH6 amino acid sequences (SEQ ID NOs: 192, 199, and 197, respectively).

FIG. 15 shows an alignment of the amino acid sequence of the light chain variable region of 18E10 (SEQ ID NO: 40) with the human germline $V_k$ L15 and JK2 amino acid sequences (SEQ ID NO: 207 and 205, respectively).

FIG. 16 shows an alignment of the amino acid sequence of the heavy chain variable regions of 19D3 (SEQ ID NO: 26) with the human germline $V_H$ 3-33, 3-16, and JH6 amino acid sequences (SEQ ID NOs: 192, 200, and 198, respectively).

FIG. 17 shows an alignment of the amino acid sequence of the light chain variable region of 19D3 (SEQ ID NO: 27) with the human germline $V_k$ L15 and JK2 amino acid sequences (SEQ ID NOs: 207 and 205, respectively).

FIG. 18 shows an alignment of the amino acid sequence of the heavy chain variable regions of 3C3 (SEQ ID NO: 52) with the human germline $V_H$ 4-34 and JH3 amino acid sequences (SEQ ID NOs: 201 and 202, respectively).

FIG. 19A shows an alignment of the amino acid sequence of the light chain variable region (VK1) of 3C3 (SEQ ID NO: 53) with the human germline $V_k$ L15 and JK2 amino acid sequences (SEQ ID NOs: 207 and 205, respectively).

FIG. 19B shows an alignment of the amino acid sequence of the light chain variable region (VK2) of 3C3 (SEQ ID NO: 54) with the human germline $V_k$ L20 and JK2 amino acid sequences (SEQ ID NOs: 208 and 206, respectively).

FIG. 20 shows an alignment of the amino acid sequence of the heavy chain variable regions of 2G6 (SEQ ID NO: 71) with the human germline $V_H$ 3-33 and JH6 amino acid sequences (SEQ ID NOs: 192 and 197, respectively).

FIG. 21 shows an alignment of the amino acid sequence of the light chain variable region of 2G6 (SEQ ID NO: 72) with the human germline $V_k$ L15 and JK2 amino acid sequences (SEQ ID NOs: 207 and 205, respectively).

FIG. 22 shows an alignment of the amino acid sequence of the heavy chain variable regions of 8A6 (SEQ ID NO: 84) with the human germline $V_H$ 3-33, 3-10, and JH6 amino acid sequences (SEQ ID NOs: 192, 193, and 197, respectively).

FIG. 23 shows an alignment of the amino acid sequence of the light chain variable region of 8A6 (SEQ ID NO: 85) with the human germline $V_k$ L18 and JK2 amino acid sequences (SEQ ID NOs: 204 and 205, respectively).

FIG. 24 shows an alignment of the amino acid sequence of the heavy chain variable regions of 9G7 (SEQ ID NO: 97) with the human germline $V_H$ 3-15, 3-10, and JH6 amino acid sequences (SEQ ID NOs: 203, 194, and 198, respectively).

FIG. 25A shows an alignment of the amino acid sequence of the light chain variable region (VK1) of 9G7 (SEQ ID NO: 98) with the human germline $V_k$ A27 and JK1 amino acid sequences (SEQ ID NOs: 209 and 210, respectively).

FIG. 25B shows an alignment of the amino acid sequence of the light chain variable region (VK2) of 9G7 (SEQ ID NO: 99) with the human germline $V_k$ A27 and JK5 amino acid sequences (SEQ ID NOs: 209 and 212, respectively).

FIG. 26 shows an alignment of the amino acid sequence of the heavy chain variable regions of 14E3 (SEQ ID NO: 115) with the human germline $V_H$ 4-34 and JH3 amino acid sequences (SEQ ID NOs: 201 and 202, respectively).

FIG. 27 shows an alignment of the amino acid sequence of the light chain variable region of 14E3 (SEQ ID NO: 116) with the human germline $V_k$ L15 and JK1 amino acid sequences (SEQ ID NOs: 207 and 211, respectively).

FIG. 28 shows an alignment of the amino acid sequence of the heavy chain variable regions of 19H8 (SEQ ID NO: 128) with the human germline $V_H$ 3-33, 3-10, and JH6 amino acid sequences (SEQ ID NOs: 192, 195, and 196, respectively).

FIG. 29A shows an alignment of the amino acid sequence of the light chain variable region (VK1) of 19H8 (SEQ ID NO: 129) with the human germline $V_k$ L18 and JK1 amino acid sequences (SEQ ID NOs: 204 and 211, respectively).

FIG. 29B shows an alignment of the amino acid sequence of the light chain variable region (VK2) of 19H8 (SEQ ID NO: 130) with the human germline $V_k$ L6 and JK4 amino acid sequences (SEQ ID NOs: 213 and 214, respectively).

FIG. 30 shows an alignment of the amino acid sequence of the heavy chain variable regions of 6G10 (SEQ ID NO: 335) with the human germline $V_H$ 3-33, 3-10, and JH6 amino acid sequences (SEQ ID NOs: 192, 195, and 196, respectively).

FIG. 31 shows an alignment of the amino acid sequence of the light chain variable region (VK1) of 6G10 (SEQ ID NO: 336) with the human germline $V_k$ L18 and JK2 amino acid sequences (SEQ ID NOs: 204 and 205, respectively).

FIG. 39C depicts the two regions in mature human GITR bound by 28F3, as determined by HDX MS.

(FIG. 45A) control mouse IgG1 antibody (10 mg/kg); (FIG. 45B) DTA-1 rat IgG2b (10 mg/kg); (FIG. 45C) DTA-1 mouse IgG1 (10 mg/kg); (FIG. 45D) DTA-1 mouse IgG2a (10 mg/kg). The number of tumor free (TF) mice per group is shown for each group of 10 mice.

(FIG. 47A) Percentage of CD8$^+$ T cells in spleen; (FIG. 47B) Percentage of CD4$^+$ cells in spleen; (FIG. 47C) Percentage of CD4$^+$ cells that are also Foxp3$^+$ in spleen; (FIG. 47D) Percentage of CD8$^+$ T cells in TILs; (FIG. 47E) Percentage of CD4$^+$ cells in TILs; (FIG. 47F) Percentage of CD4$^+$ cells that are also Foxp3$^+$ in TILs.

(FIG. 48A) control mouse IgG1 antibody; (FIG. 48B) mGITR.7 mIgG1; (FIG. 48C) mGITR.7 mIgG1-D265A; (FIG. 48D) mGITR.7 mIgG2a; (FIG. 48E) mGITR.7 mIgG2b; (FIG. 48F) mGITR.7 rat IgG2b. The number of TF mice per group is shown for each group of 9 mice.

(FIG. 51A) control mouse IgG1 antibody; (FIG. 51B) DTA-1 mouse IgG2a; (FIG. 51C) DTA-1 rat IgG2b; (FIG. 51D) DTA-1 mouse IgG1; (FIG. 51E) DTA-1 mouse IgG1-D265A. The number of TF mice per group is shown for each group of up to 10 mice.

FIG. 58A shows IFN-γ secretion from donor CD4 T cells stimulated with OKT3 expressing CHO cells and various concentrations of anti-human GITR antibodies with an IgG2-IgG1 constant region. FIG. 58B shows IL-2 secretion from donor CD4 T cells stimulated with OKT3 expressing CHO cells and various concentrations of an IgG1 heavy chain constant domain or an IgG2-IgG1 hybrid heavy chain constant domain. FIG. 58C shows and IL-2 secretion from donor CD4 T cells stimulated with OKT3 expressing CHO cells and various concentrations of effectorless versions (IgG1.1) of the antibodies in FIGS. 55A and B.

FIGS. 61A-61F show the effect of 28F3.IgG1 ("GITR.6IgG1") and 28F3.IgG1.1 ("GITR.6IgG1.1") on NK cell induced lysis of activated CD4+ cells, CD8+ cells and Treg-enriched cells from two different donors.

FIGS. 63A and 63B show the mean volume and median volume, respectively, of MC38 tumors in mice treated with control hIgG1 antibody, 28F3.IgG1 ("anti-GITR IgG1"), and 28F3.IgG1.1 ("anti-GITR IgG1.1").

FIGS. 64A and 64B show the mean % body weight change and median % body weight change, respectively, of mice with MC38 tumors treated with control hIgG1 antibody, 28F3.IgG1 ("anti-GITR IgG1"), and 28F3.IgG1.1 ("anti-GITR IgG1.1").

FIG. 73A shows GITR and early endosome marker EEA2 co-localization analysis at time zero.

FIG. 73B shows GITR and early endosome marker EEA2 co-localization analysis at time 30 and 120 minutes.

FIG. 73C shows the results of quantification of endosomal co-localization shown in FIGS. 73A and 73B plotted as the ratio of colocalized pixel intensity relative to total staining.

DETAILED DESCRIPTION

Figure 32:
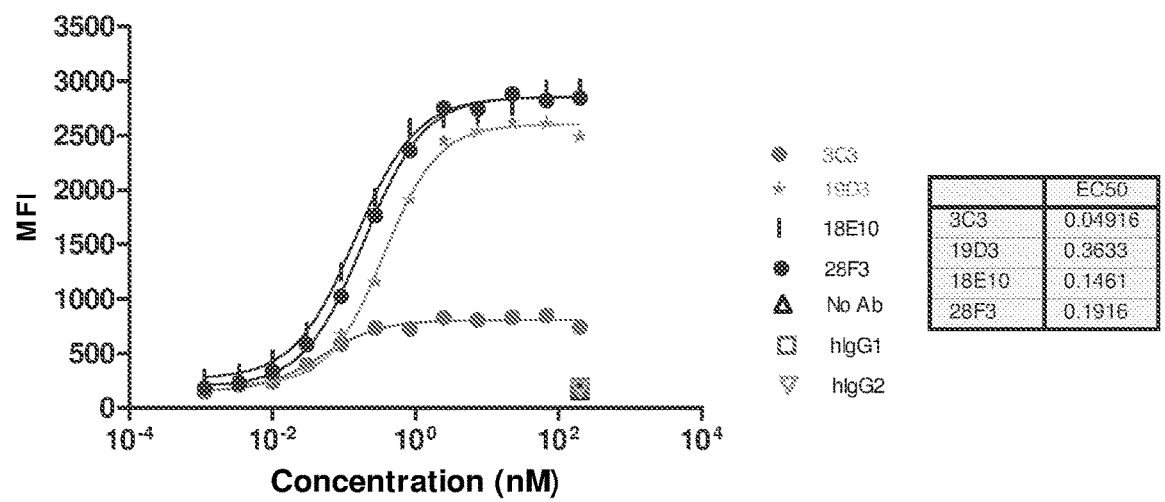
FIG. 32 shows the binding affinity (in nM) of various anti-GITR antibodies for activated human T cells, with no antibody, IgG1, and hIgG2 antibody controls, as assessed by FACS.

Described herein are isolated antibodies, particularly monoclonal antibodies, e.g., human monocloncal antibodies, which specifically bind to GITR and thereby activate downstream GITR signaling ("agonist anti-GITR antibodies"). In certain embodiments, the antibodies described herein are derived from particular heavy and light chain germline sequences and/or comprise particular structural features such as CDR regions comprising particular amino acid sequences. Provided herein are isolated antibodies, methods of making such antibodies, immunoconjugates and bispecific molecules comprising such antibodies, and pharmaceutical compositions formulated to contain the antibodies. Also provided herein are methods of using the antibodies for immune response enhancement, alone or in combination with other immunostimulatory agents (e.g., antibodies) and/or cancer therapies. Accordingly, the anti-GITR antibodies described herein may be used in a treatment in a wide variety of therapeutic applications, including, for example, inhibiting tumor growth and treating viral infections.

Definitions

In order that the present description may be more readily understood, certain terms are first defined. Additional definitions are set forth throughout the detailed description.

The term "glucocorticoid-inducible TNF receptor" or "GITR" as used herein refers to a receptor that is a member of the TNF-receptor superfamily, which binds to GITR ligand (GITR-L). GITR is also referred to as tumor necrosis factor receptor superfamily, member 18 (TNFRSF18), AITR and CD357. The term "GITR" includes any variants or isoforms of GITR which are naturally expressed by cells. Accordingly, antibodies described herein may cross-react with GITR from species other than human (e.g., cynomolgus GITR). Alternatively, the antibodies may be specific for human GITR and may not exhibit any cross-reactivity with other species. GITR or any variants and isoforms thereof, may either be isolated from cells or tissues which naturally express them or be recombinantly produced using well-known techniques in the art and/or those described herein.

Three isoforms of human GITR have been identified, all of which share the same extracellular domain, except for its C-terminal portion. Variant 1 (Accession No. NP_004186; SEQ ID NO: 1) consists of 241 amino acids and represents the longest transcript. It contains an extra coding segment that leads to a frame shift, compared to variant 2. The resulting protein (isoform 1) contains a distinct and shorter C-terminus, as compared to isoform 2. Variant 2 (Accession No. NP_683699; SEQ ID NO: 2) encodes the longest protein (isoform 2), consisting of 255 amino acids, and is soluble. Variant 3 (Accession No. NP_683700; SEQ ID NO: 3) contains an extra coding segment that leads to a frame shift, compared to variant 2. The resulting protein (isoform 3) contains a distinct and shorter C-terminus, as compared to isoform 2, and consists of 234 amino acids.

Below are the amino acid sequences of the three known human GITR isoforms, cyno GITR and GITR-L.

Human GITR isoform 1 (Accession No. NP_004186; SEQ ID NO: 1; encoded by the nucleotide sequence having Accession No. NM_004195.2):

MAQHGAMGAFRALCGLALLCALSLGQRPTGGPGCGPGRLLLGTGTDARCC

RVHTTRCCRDYPGEECCSEWDCMCVQPEFHCGDPCCTTCRHHPCPPGQGV

QSQGKFSFGFQCIDCASGTFSGGHEGHCKPWTDCTQFGFLTVFPGNKTHN

AVCVPGSPPAEPLGWLTVVLLAVAACVLLLTSAQLGLHIWQLRSQCMWPR

ETQLLLEVPPSTEDARSCQFPEEERGERSAEEKGRLGDLWV

Human GITR isoform 2 (Accession No. NP_683699.1; SEQ ID NO: 2; encoded by the nucleotide sequence having Accession No. NM_148901.1):

MAQHGAMGAFRALCGLALLCALSLGQRPTGGPGCGPGRLLLGTGTDARCC

RVHTTRCCRDYPGEECCSEWDCMCVQPEFHCGDPCCTTCRHHPCPPGQGV

QSQGKFSFGFQCIDCASGTFSGGHEGHCKPWTDCCWRCRRRPKTPEAASS

PRKSGASDRQRRRGGWETCGCEPGRPPGPPTAASPSPGAPQAAGALRSAL

GRALLPWQQKWVQEGGSDQRPGPCSSAAAAGPCRRERETQSWPPSSLAGP

DGVGS

Human GITR isoform 3 (Accession No. NP_683700.1; SEQ ID NO: 3; encoded by the nucleotide sequence having Accession No. NM_148902.1):

MAQHGAMGAFRALCGLALLCALSLGQRPTGGPGCGPGRLLLGTGTDARCC

RVHTTRCCRDYPGEECCSEWDCMCVQPEFHCGDPCCTTCRHHPCPPGQGV

QSQGKFSFGFQCIDCASGTFSGGHEGHCKPWTDCTQFGFLTVFPGNKTHN

AVCVPGSPPAEPLGWLTVVLLAVAACVLLLTSAQLGLHIWQLRKTQLLLE

VPPSTEDARSCQFPEEERGERSAEEKGRLGDLWV

The signal sequence of isoforms 1-3 corresponds to amino acids 1-25. Thus, the mature isoforms 1, 2 and 3 consist of amino acids 26 to 241, 255 or 234, respectively. The extracellular domain of mature GITR consists of amino acids 26-162 and has the amino acid sequence:

(SEQ ID NO: 4)
QRPTGGPGCGPGRLLLGTGTDARCCRVHTTRCCRDYPGEECCSEWDCMCV

QPEFHCGDPCCTTCRHHPCPPGQGVQSQGKFSFGFQCIDCASGTFSGGHE

GHCKPWTDCTQFGFLTVFPGNKTHNAVCVPGSPPAEP

Cynomolgus GITR protein sequence (SEQ ID NO: 5):

MCASGTLCCLALLCAASLGQRPTGGPGCGPGRLLLGTGKDARCCRVHPTR

CCRDYQGEECCSEWDCVCVQPEFHCGNPCCTTCQHHPCPSGQGVQPQGKF

SFGFRCVDCALGTFSRGHDGHCKPWTDCTQFGFLTVFPGNKTHNAVCVPG

SPPAEPPGWLTIILLAVAACVLLLTSAQLGLHIWQLRSQPTGPRETQLLL

EVPPSTEDASSCQFPEEERGERLAEEKGRLGDLWV

Human GITR-L protein sequence (Accession No. NP_005083.2; SEQ ID NO: 6):

MTLHPSPITCEFLFSTALISPKMCLSHLENMPLSHSRTQGAQRSSWKLWL

FCSIVMLLFLCSFSWLIFIFLQLETAKEPCMAKFGPLPSKWQMASSEPPC

VNKVSDWKLEILQNGLYLIYGQVAPNANYNDVAPFEVRLYKNKDMIQTLT

NKSKIQNVGGTYELHVGDTIDLIFNSEHQVLKNNTYWGIILLANPQFIS

The term "antibody" as used to herein includes whole antibodies and any antigen binding fragments (i.e., "antigen-binding portions") or single chains thereof. An "antibody" refers, in one embodiment, to a glycoprotein comprising at least two heavy (H) chains and two light (L) chains interconnected by disulfide bonds, or an antigen binding portion thereof. Each heavy chain is comprised of a heavy chain variable region (abbreviated herein as $V_H$) and a heavy chain constant region. In certain naturally occurring antibodies, the heavy chain constant region is comprised of three domains, CH1, CH2 and CH3. In certain naturally occurring antibodies, each light chain is comprised of a light chain variable region (abbreviated herein as $V_L$) and a light chain constant region. The light chain constant region is comprised of one domain, CL. The $V_H$ and $V_L$ regions can be further subdivided into regions of hypervariability, termed complementarity determining regions (CDR), interspersed with regions that are more conserved, termed framework regions (FR). Each $V_H$ and $V_L$ is composed of three CDRs and four FRs, arranged from amino-terminus to carboxy-terminus in the following order: FR1, CDR1, FR2, CDR2, FR3, CDR3, FR4. The variable regions of the heavy and light chains contain a binding domain that interacts with an antigen. The constant regions of the antibodies may mediate the binding of the immunoglobulin to host tissues or factors, including various cells of the immune system (e.g., effector cells) and the first component (C1q) of the classical complement system.

Antibodies typically bind specifically to their cognate antigen with high affinity, reflected by a dissociation constant ($K_D$) of $10^{-5}$ to $10^{-11}$ M or less. Any $K_D$ greater than about $10^{-4}$ M is generally considered to indicate nonspecific binding. As used herein, an antibody that "binds specifically" to an antigen refers to an antibody that binds to the antigen and substantially identical antigens with high affinity, which means having a $K_D$ of $10^{-7}$ M or less, preferably $10^{-8}$ M or less, even more preferably $5 \times 10^{-9}$ M or less, and most preferably between $10^{-8}$ M and $10^{-10}$ M or less, but does not bind with high affinity to unrelated antigens. An antigen is "substantially identical" to a given antigen if it exhibits a high degree of sequence identity to the given antigen, for example, if it exhibits at least 80%, at least 90%, preferably at least 95%, more preferably at least 97%, or even more preferably at least 99% sequence identity to the sequence of the given antigen. By way of example, an antibody that binds specifically to human GITR may also have cross-reactivity with GITR antigens from certain primate species (e.g., cynomolgus GITR), but may not cross-react with GITR antigens from other species or with an antigen other than GITR.

An immunoglobulin may be from any of the commonly known isotypes, including but not limited to IgA, secretory IgA, IgG and IgM. The IgG isotype is divided in subclasses in certain species: IgG1, IgG2, IgG3 and IgG4 in humans, and IgG1, IgG2a, IgG2b and IgG3 in mice. In certain embodiments, the anti-GITR antibodies described herein are of the IgG1 or IgG2 subtype. Immunoglobulins, e.g., IgG1, exist in several allotypes, which differ from each other in at most a few amino acids. "Antibody" includes, by way of example, both naturally occurring and non-naturally occurring antibodies; monoclonal and polyclonal antibodies; chimeric and humanized antibodies; human and nonhuman antibodies; wholly synthetic antibodies; and single chain antibodies.

The term "antigen-binding portion" of an antibody, as used herein, refers to one or more fragments of an antibody that retain the ability to specifically bind to an antigen (e.g., human GITR). Such "fragments" are, for example between about 8 and about 1500 amino acids in length, suitably between about 8 and about 745 amino acids in length, suitably about 8 to about 300, for example about 8 to about 200 amino acids, or about 10 to about 50 or 100 amino acids in length. It has been shown that the antigen-binding function of an antibody can be performed by fragments of a full-length antibody. Examples of binding fragments encompassed within the term "antigen-binding portion" of an antibody, e.g., an anti-GITR antibody described herein, include (i) a Fab fragment, a monovalent fragment consisting of the $V_L$, $V_H$, CL and CH1 domains; (ii) a $F(ab')_2$ fragment, a bivalent fragment comprising two Fab fragments linked by a disulfide bridge at the hinge region; (iii) a Fd fragment consisting of the $V_H$ and CH1 domains; (iv) a Fv fragment consisting of the $V_L$ and $V_H$ domains of a single arm of an antibody, (v) a dAb fragment (Ward et al., (1989) *Nature* 341:544-546), which consists of a $V_H$ domain; and (vi) an isolated complementarity determining region (CDR) or (vii) a combination of two or more isolated CDRs which may optionally be joined by a synthetic linker. Furthermore, although the two domains of the Fv fragment, $V_L$ and $V_H$, are coded for by separate genes, they can be joined, using recombinant methods, by a synthetic linker that enables them to be made as a single protein chain in which the $V_L$ and $V_H$ regions pair to form monovalent molecules (known as single chain Fv (scFv); see e.g., Bird et al. (1988) *Science* 242:423-426; and Huston et al. (1988) *Proc. Natl. Acad. Sci. USA* 85:5879-5883). Such single chain antibodies are also intended to be encompassed within the term "antigen-binding portion" of an antibody. These antibody fragments are obtained using conventional techniques known to those with skill in the art, and the fragments are screened for utility in the same manner as are intact antibodies. Antigen-binding portions can be produced by recombinant DNA techniques, or by enzymatic or chemical cleavage of intact immunoglobulins.

A "bispecific" or "bifunctional antibody" is an artificial hybrid antibody having two different heavy/light chain pairs and two different binding sites. Bispecific antibodies can be produced by a variety of methods including fusion of hybridomas or linking of Fab' fragments. See, e.g., Songsivilai & Lachmann, Clin. Exp. Immunol. 79:315-321 (1990); Kostelny et al., *J. Immunol.* 148, 1547-1553 (1992).

The term "monoclonal antibody," as used herein, refers to an antibody that displays a single binding specificity and affinity for a particular epitope or a composition of antibodies in which all antibodies display a single binding specificity and affinity for a particular epitope. Accordingly, the term "human monoclonal antibody" refers to an antibody or antibody composition that display(s) a single binding specificity and which has variable and optional constant regions derived from human germline immunoglobulin sequences. In one embodiment, human monoclonal antibodies are produced by a hybridoma which includes a B cell obtained from a transgenic non-human animal, e.g., a transgenic mouse, having a genome comprising a human heavy chain transgene and a light chain transgene fused to an immortalized cell.

The term "recombinant human antibody," as used herein, includes all human antibodies that are prepared, expressed, created or isolated by recombinant means, such as (a) antibodies isolated from an animal (e.g., a mouse) that is transgenic or transchromosomal for human immunoglobulin genes or a hybridoma prepared therefrom, (b) antibodies isolated from a host cell transformed to express the antibody, e.g., from a transfectoma, (c) antibodies isolated from a recombinant, combinatorial human antibody library, and (d) antibodies prepared, expressed, created or isolated by any other means that involve splicing of human immunoglobulin gene sequences to other DNA sequences. Such recombinant human antibodies comprise variable and constant regions that utilize particular human germline immunoglobulin sequences are encoded by the germline genes, but include subsequent rearrangements and mutations which occur, for example, during antibody maturation. As known in the art (see, e.g., Lonberg (2005) Nature Biotech. 23(9):1117-1125), the variable region contains the antigen binding domain, which is encoded by various genes that rearrange to form an antibody specific for a foreign antigen. In addition to rearrangement, the variable region can be further modified by multiple single amino acid changes (referred to as somatic mutation or hypermutation) to increase the affinity of the antibody to the foreign antigen. The constant region will change in further response to an antigen (i.e., isotype switch). Therefore, the rearranged and somatically mutated nucleic acid molecules that encode the light chain and heavy chain immunoglobulin polypeptides in response to an antigen may not have sequence identity with the original nucleic acid molecules, but instead will be substantially identical or similar (i.e., have at least 80% identity).

A "human" antibody (HuMAb) refers to an antibody having variable regions in which both the framework and CDR regions are derived from human germline immunoglobulin sequences. Furthermore, if the antibody contains a constant region, the constant region also is derived from human germline immunoglobulin sequences. The antibodies described herein may include amino acid residues not encoded by human germline immunoglobulin sequences (e.g., mutations introduced by random or site-specific mutagenesis in vitro or by somatic mutation in vivo). However, the term "human antibody", as used herein, is not intended to include antibodies in which CDR sequences derived from the germline of another mammalian species, such as a mouse, have been grafted onto human framework sequences. The terms "human" antibodies and "fully human" antibodies and are used synonymously.

A "humanized" antibody refers to an antibody in which some, most or all of the amino acids outside the CDR domains of a non-human antibody are replaced with corresponding amino acids derived from human immunoglobulins. In one embodiment of a humanized form of an antibody, some, most or all of the amino acids outside the CDR domains have been replaced with amino acids from human immunoglobulins, whereas some, most or all amino acids within one or more CDR regions are unchanged. Small additions, deletions, insertions, substitutions or modifications of amino acids are permissible as long as they do not abrogate the ability of the antibody to bind to a particular antigen. A "humanized" antibody retains an antigenic specificity similar to that of the original antibody.

A "chimeric antibody" refers to an antibody in which the variable regions are derived from one species and the constant regions are derived from another species, such as an antibody in which the variable regions are derived from a mouse antibody and the constant regions are derived from a human antibody.

As used herein, "isotype" refers to the antibody class (e.g., IgG1, IgG2, IgG3, IgG4, IgM, IgA1, IgA2, IgD, and IgE antibody) that is encoded by the heavy chain constant region genes.

"Allotype" refers to naturally occurring variants within a specific isotype group, which variants differ in a few amino acids (see, e.g., Jefferis et al. (2009) mAbs 1:1). Antibodies described herein may be of any allotype. As used herein, antibodies referred to as "IgG1f" or "IgG1.1f" isotype are IgG1 and effectorless IgG1.1 antibodies, respectively, of the allotype "f," i.e., having 214R, 356E and 358M according to the EU index as in Kabat, as shown, e.g., in SEQ ID NO: 7 (see underlined residues in SEQ ID NO: 7 of Table 15).

The phrases "an antibody recognizing an antigen" and "an antibody specific for an antigen" are used interchangeably herein with the term "an antibody which binds specifically to an antigen."

An "isolated antibody," as used herein, is intended to refer to an antibody which is substantially free of other antibodies having different antigenic specificities (e.g., an isolated antibody that specifically binds to GITR is substantially free of antibodies that specifically bind antigens other than GITR). An isolated antibody that specifically binds to an epitope of GITR may, however, have cross-reactivity to other GITR proteins from different species.

As used herein, an antibody that "inhibits binding of GITR-L to GITR" is intended to refer to an antibody that inhibits the binding of GITR-L to GITR, e.g., in binding assays using 3A9-hGITR cells, with an EC50 of about 1 µg/mL or less, such as about 0.9 µg/mL or less, about 0.85 µg/mL or less, about 0.8 µg/mL or less, about 0.75 µg/mL or less, about 0.7 µg/mL or less, about 0.65 µg/mL or less, about 0.6 µg/mL or less, about 0.55 µg/mL or less, about 0.5 µg/mL or less, about 0.45 µg/mL or less, about 0.4 µg/mL or less, about 0.35 µg/mL or less, about 0.3 µg/mL or less, about 0.25 µg/mL or less, about 0.2 µg/mL or less, about 0.15 µg/mL or less, or about 0.1 µg/mL or less, in art-recognized methods, e.g., the FACS-based binding assays described herein.

An "effector function" refers to the interaction of an antibody Fc region with an Fc receptor or ligand, or a biochemical event that results therefrom. Exemplary "effector functions" include C1q binding, complement dependent cytotoxicity (CDC), Fc receptor binding, FcγR-mediated effector functions such as ADCC and antibody dependent cell-mediated phagocytosis (ADCP), and downregulation of a cell surface receptor (e.g., the B cell receptor; BCR). Such effector functions generally require the Fc region to be combined with a binding domain (e.g., an antibody variable domain).

An "Fc receptor" or "FcR" is a receptor that binds to the Fc region of an immunoglobulin. FcRs that bind to an IgG antibody comprise receptors of the FcγR family, including allelic variants and alternatively spliced forms of these receptors. The FcγR family consists of three activating (FcγRI, FcγRIII, and FcγRIV in mice; FcγRIA, FcγRIIA, and FcγRIIIA in humans) and one inhibitory (FcγRIIB) receptor. Various properties of human FcγRs are summarized in Table 1. The majority of innate effector cell types coexpress one or more activating FcγR and the inhibitory FcγRIIB, whereas natural killer (NK) cells selectively express one activating Fc receptor (FcγRIII in mice and FcγRIIIA in humans) but not the inhibitory FcγRIIB in mice and humans. Human IgG1 binds to most human Fc receptors and is considered equivalent to murine IgG2a with respect to the types of activating Fc receptors that it binds to.

TABLE 1

Properties of human FcγRs

| Fcγ | Allelic variants | Affinity for human IgG | Isotype preference | Cellular distribution |
|---|---|---|---|---|
| FcγRI | None described | High ($K_D$ ~10 nM) | IgG1 = 3 > 4 >> 2 | Monocytes, macrophages, activated neutrophils, dentritic cells? |
| FcγRIIA | H131 | Low to medium | IgG1 > 3 > 2 > 4 | Neutrophils, monocytes, macrophages, eosinophils, dentritic cells, platelets |
| | R131 | Low | IgG1 > 3 > 4 > 2 | |
| FcγRIIIA | V158 | Medium | IgG1 = 3 >> 4 > 2 | NK cells, monocytes, macrophages, mast cells, eosinophils, dentritic cells? |
| | F158 | Low | IgG1 = 3 >> 4 > 2 | |
| FcγRIIB | I232 | Low | IgG1 = 3 = 4 > 2 | B cells, monocytes, macrophages, dentritic cells, mast cells |
| | T232 | Low | IgG1 = 3 = 4 > 2 | |

An "Fc region" (fragment crystallizable region) or "Fc domain" or "Fc" refers to the C-terminal region of the heavy chain of an antibody that mediates the binding of the immunoglobulin to host tissues or factors, including binding to Fc receptors located on various cells of the immune system (e.g., effector cells) or to the first component (C1q) of the classical complement system. Thus, an Fc region comprises the constant region of an antibody excluding the first constant region immunoglobulin domain (e.g., CH1 or CL). In IgG, IgA and IgD antibody isotypes, the Fc region comprises two identical protein fragments, derived from the second ($C_{H2}$) and third ($C_{H3}$) constant domains of the antibody's two heavy chains; IgM and IgE Fc regions comprise three heavy chain constant domains ($C_H$ domains 2-4) in each polypeptide chain. For IgG, the Fc region comprises immunoglobulin domains Cγ2 and Cγ3 and the hinge between Cγ1 and Cγ2. Although the boundaries of the Fc region of an immunoglobulin heavy chain might vary, the human IgG heavy chain Fc region is usually defined to stretch from an amino acid residue at position C226 or P230 (or amino acid between these two amino acids) to the carboxy-terminus of the heavy chain, wherein the numbering is according to the EU index as in Kabat. The $C_{H2}$ domain of a human IgG Fc region extends from about amino acid 231 to about amino acid 340, whereas the $C_{H3}$ domain is positioned on C-terminal side of a $C_{H2}$ domain in an Fc region, i.e., it extends from about amino acid 341 to about amino acid 447 of an IgG. As used herein, the Fc region may be a native sequence Fc, including any allotypic variant, or a variant Fc (e.g., a non-naturally occurring Fc). Fc may also refer to this region in isolation or in the context of an Fc-comprising protein polypeptide such as a "binding protein comprising an Fc region," also referred to as an "Fc fusion protein" (e.g., an antibody or immunoadhesin).

A "native sequence Fc region" or "native sequence Fc" comprises an amino acid sequence that is identical to the amino acid sequence of an Fc region found in nature. Native sequence human Fc regions include a native sequence human IgG1 Fc region; native sequence human IgG2 Fc region; native sequence human IgG3 Fc region; and native sequence human IgG4 Fc region as well as naturally occurring variants thereof. Native sequence Fc include the various allotypes of Fcs (see, e.g., Jefferis et al. (2009) mAbs 1:1).

A "hinge", "hinge domain" or "hinge region" or "antibody hinge region" refers to the domain of a heavy chain constant region that joins the CH1 domain to the CH2 domain and includes the upper, middle, and lower portions of the hinge (Roux et al. J. Immunol. 1998 161:4083). The hinge provides varying levels of flexibility between the binding and effector regions of an antibody and also provides sites for intermolecular disulfide bonding between the two heavy chain constant regions. As used herein, a hinge starts at Glu216 and ends at Gly237 for all IgG isotypes (Roux et al., 1998 J Immunol 161:4083). The sequences of wildtype IgG1, IgG2, IgG3 and IgG4 hinges are show in Tables 2 and 9.

TABLE 2

Hinge region amino acids

| Ig Type | C-terminal $C_H1$* | Upper Hinge | Middle Hinge | Lower Hinge |
|---|---|---|---|---|
| IgG1 | VDKRV (SEQ ID NO: 299) | EPKSCDKTHT (SEQ ID NO: 301) | CPPCP (SEQ ID NO: 305) | APELLGG (SEQ ID NO: 313) |
| IgG2 | VDKTV (SEQ ID NO: 300) | ERK | CCVECPPCP (SEQ ID NO: 306) | APPVAG (SEQ ID NO: 314) |
| IgG3 (17-15-15-15) | VDKRV (SEQ ID NO: 299) | ELKTPLGDTTHT (SEQ ID NO: 302) | CPRCP (EPKSCDTPPPCPRCP)$_3$ (SEQ ID NO: 307) | APELLGG (SEQ ID NO: 313) |
| IgG3 (17-15-15) | VDKRV (SEQ ID NO: 299) | ELKTPLGDTTHT (SEQ ID NO: 302) | CPRCP (EPKSCDTPPPCPRCP)$_2$ (SEQ ID NO: 308) | APELLGG (SEQ ID NO: 313) |
| IgG3 (17-15) | VDKRV (SEQ ID NO: 299) | ELKTPLGDTTHT (SEQ ID NO: 302) | CPRCP (EPKSCDTPPPCPRCP)$_1$ (SEQ ID NO: 309) | APELLGG (SEQ ID NO: 313) |
| IgG3 (15-15-15) | VDKRV (SEQ ID NO: 299) | EPKS (SEQ ID NO: 303) | CDTPPPCPRCP (EPKSCDTPPPCPRCP)$_2$ (SEQ ID NO: 310) | APELLGG (SEQ ID NO: 313) |
| IgG3 (15) | VDKRV (SEQ ID NO: 299) | EPKS (SEQ ID NO: 303) | CDTPPPCPRCP (SEQ ID NO: 311) | APELLGG (SEQ ID NO: 313) |
| IgG4 | VDKRV (SEQ ID NO: 299) | ESKYGPP (SEQ ID NO: 304) | CPSCP (SEQ ID NO: 312) | APEFLGG (SEQ ID NO: 313) |

*C-terminal amino acid sequences of the CH1 domains.

The term "hinge" includes wildtype hinges (such as those set forth in Table 15), as well as variants thereof (e.g., non-naturally-occurring hinges or modified hinges). For example, the term "IgG2 hinge" includes wildtype IgG2 hinge, as shown in Table 15, and variants having 1, 2, 3, 4, 5, 1-3, 1-5, 3-5 and/or at most 5, 4, 3, 2, or 1 mutations, e.g., substitutions, deletions or additions. Exemplary IgG2 hinge variants include IgG2 hinges in which 1, 2, 3 or all 4 cysteines (C219, C220, C226 and C229) are changed to another amino acid. In a specific embodiment, an IgG2 comprises a C219S substitution. In certain embodiments, a hinge is a hybrid hinge that comprises sequences from at least two isotypes. For example, a hinge may comprise the upper, middle or lower hinge from one isotype and the remainder of the hinge from one or more other isotypes. For example, a hinge can be an IgG2/IgG1 hinge, and may comprise, e.g., the upper and middle hinges of IgG2 and the lower hinge of IgG1. A hinge may have effector function or be deprived of effector function. For example, the lower hinge of wildtype IgG1 provides effector function.

The term "CH1 domain" refers to the heavy chain constant region linking the variable domain to the hinge in a heavy chain constant domain. As used herein, a CH1 domain starts at A118 and ends at V215. The term "CH1 domain" includes wildtype CH1 domains (such as having SEQ ID NO: 278 for IgG1 and SEQ ID NO: 279 for IgG2; Table 15), as well as variants thereof (e.g., non-naturally-occurring CH1 domains or modified CH1 domains). For example, the term "CH1 domain" includes wildtype CH1 domains and variants having 1, 2, 3, 4, 5, 1-3, 1-5, 3-5 and/or at most 5, 4, 3, 2, or 1 mutations, e.g., substitutions, deletions or additions. Exemplary CH1 domains include CH1 domains with mutations that modify a biological activity of an antibody, such as ADCC, CDC or half-life. Modifications to the CH1 domain that affect a biological activity of an antibody are provided herein.

The term "CH2 domain" refers to the heavy chain constant region linking the hinge to the CH3 domain in a heavy chain constant domain. As used herein, a CH2 domain starts at P238 and ends at K340. The term "CH2 domain" includes wildtype CH2 domains (such as having SEQ ID NO: 280 for IgG1 and SEQ ID NO: 297 for IgG2; Table 15), as well as variants thereof (e.g., non-naturally-occurring CH2 domains or modified CH2 domains). For example, the term "CH2 domain" includes wildtype CH2 domains and variants having 1, 2, 3, 4, 5, 1-3, 1-5, 3-5 and/or at most 5, 4, 3, 2, or 1 mutations, e.g., substitutions, deletions or additions. Exemplary CH2 domains include CH2 domains with mutations that modify a biological activity of an antibody, such as ADCC, CDC or half-life. In certain embodiments, a CH2 domain comprises the substitutions A330S/P331S that reduce effector function. Other modifications to the CH2 domain that affect a biological activity of an antibody are provided herein.

The term "CH3 domain" refers to the heavy chain constant region that is C-terminal to the CH2 domain in a heavy chain constant domain. As used herein, a CH3 domain starts at G341 and ends at K447. The term "CH3 domain" includes wildtype CH3 domains (such as having SEQ ID NO: 282 for IgG1 and SEQ ID NO: 298 for IgG2; Table 15), as well as variants thereof (e.g., non-naturally-occurring CH3 domains or modified CH3 domains). For example, the term "CH3 domain" includes wildtype CH3 domains and variants having 1, 2, 3, 4, 5, 1-3, 1-5, 3-5 and/or at most 5, 4, 3, 2, or 1 mutations, e.g., substitutions, deletions or additions. Exemplary CH3 domains include CH3 domains with mutations that modify a biological activity of an antibody, such as ADCC, CDC or half-life. Modifications to the CH3 domain that affect a biological activity of an antibody are provided herein.

A "native sequence Fc region" or "native sequence Fc" comprises an amino acid sequence that is identical to the amino acid sequence of an Fc region found in nature. Native sequence human Fc regions include a native sequence human IgG1 Fc region; native sequence human IgG2 Fc region; native sequence human IgG3 Fc region; and native sequence human IgG4 Fc region as well as naturally occurring variants thereof. Native sequence Fc includes the various allotypes of Fcs (see, e.g., Jefferis et al. (2009) mAbs 1:1).

The term "epitope" or "antigenic determinant" refers to a site on an antigen (e.g., GITR) to which an immunoglobulin or antibody specifically binds. Epitopes can be formed both from contiguous amino acids (usually a linear epitope) or noncontiguous amino acids juxtaposed by tertiary folding of a protein (usually a conformational epitope). Epitopes formed from contiguous amino acids are typically, but not always, retained on exposure to denaturing solvents, whereas epitopes formed by tertiary folding are typically lost on treatment with denaturing solvents. An epitope typically includes at least 3, 4, 5, 6, 7, 8, 9, 10, 11, 12, 13, 14 or 15 amino acids in a unique spatial conformation. Methods for determining what epitopes are bound by a given antibody (i.e., epitope mapping) are well known in the art and include, for example, immunoblotting and immunoprecipitation assays, wherein overlapping or contiguous peptides from (e.g., from GITR) are tested for reactivity with a given antibody (e.g., anti-GITR antibody). Methods of determining spatial conformation of epitopes include techniques in the art and those described herein, for example, x-ray crystallography, 2-dimensional nuclear magnetic resonance and HDX-MS (see, e.g., *Epitope Mapping Protocols in Methods in Molecular Biology*, Vol. 66, G. E. Morris, Ed. (1996)).

The term "epitope mapping" refers to the process of identification of the molecular determinants for antibody-antigen recognition.

The term "binds to the same epitope" with reference to two or more antibodies means that the antibodies bind to the same segment of amino acid residues, as determined by a given method. Techniques for determining whether antibodies bind to the "same epitope on GITR" with the antibodies described herein include, for example, epitope mapping methods, such as, x-ray analyses of crystals of antigen:antibody complexes which provides atomic resolution of the epitope and hydrogen/deuterium exchange mass spectrometry (HDX-MS). Other methods monitor the binding of the antibody to antigen fragments or mutated variations of the antigen where loss of binding due to a modification of an amino acid residue within the antigen sequence is often considered an indication of an epitope component. In addition, computational combinatorial methods for epitope mapping can also be used. These methods rely on the ability of the antibody of interest to affinity isolate specific short peptides from combinatorial phage display peptide libraries. Antibodies having the same VH and VL or the same CDR1, 2 and 3 sequences are expected to bind to the same epitope.

Antibodies that "compete with another antibody for binding to a target" refer to antibodies that inhibit (partially or completely) the binding of the other antibody to the target. Whether two antibodies compete with each other for binding to a target, i.e., whether and to what extent one antibody inhibits the binding of the other antibody to a target, may be determined using known competition experiments. In certain embodiments, an antibody competes with, and inhibits binding of another antibody to a target by at least 10%, 20%, 30%, 40%, 50%, 60%, 70%, 80%, 90% or 100%. The level of inhibition or competition may be different depending on which antibody is the "blocking antibody" (i.e., the cold antibody that is incubated first with the target). Competition assays can be conducted as described, for example, in Ed Harlow and David Lane, Cold Spring Harb Protoc; 2006; doi:10.1101/pdb.prot4277 or in Chapter 11 of "Using Antibodies" by Ed Harlow and David Lane, Cold Spring Harbor Laboratory Press, Cold Spring Harbor, N.Y., USA 1999. Competing antibodies bind to the same epitope, an overlapping epitope or to adjacent epitopes (e.g., as evidenced by steric hindrance).

Other competitive binding assays include: solid phase direct or indirect radioimmunoassay (RIA), solid phase direct or indirect enzyme immunoassay (EIA), sandwich competition assay (see Stahli et al., *Methods in Enzymology* 9:242 (1983)); solid phase direct biotin-avidin EIA (see Kirkland et al., *J. Immunol.* 137:3614 (1986)); solid phase direct labeled assay, solid phase direct labeled sandwich assay (see Harlow and Lane, Antibodies: A Laboratory Manual, Cold Spring Harbor Press (1988)); solid phase direct label RIA using 1-125 label (see Morel et al., *Mol. Immunol.* 25(1):7 (1988)); solid phase direct biotin-avidin EIA (Cheung et al., *Virology* 176:546 (1990)); and direct labeled RIA. (Moldenhauer et al., *Scand. J. Immunol.* 32:77 (1990)).

As used herein, the terms "specific binding," "selective binding," "selectively binds," and "specifically binds," refer to antibody binding to an epitope on a predetermined antigen. Typically, the antibody (i) binds with an equilibrium dissociation constant ($K_D$) of approximately less than $10^{-7}$ M, such as approximately less than $10^{-8}$ M, $10^{-9}$ M or $10^{-10}$ M or even lower when determined by, e.g., surface plasmon resonance (SPR) technology in a BIACORE 2000 instrument using the predetermined antigen, e.g., recombinant human GITR, as the analyte and the antibody as the ligand, or Scatchard analysis of binding of the antibody to antigen positive cells, and (ii) binds to the predetermined antigen with an affinity that is at least two-fold greater than its affinity for binding to a non-specific antigen (e.g., BSA, casein) other than the predetermined antigen or a closely-related antigen. Accordingly, an antibody that "specifically binds to human GITR" refers to an antibody that binds to soluble or cell bound human GITR with a $K_D$ of $10^{-7}$ M or less, such as approximately less than $10^{-8}$ M, $10^{-9}$ M or $10^{-10}$ M or even lower. An antibody that "cross-reacts with cynomolgus GITR" refers to an antibody that binds to cynomolgus GITR with a $K_D$ of $10^{-7}$ M or less, such as approximately less than $10^{-8}$ M, $10^{-9}$ M or $10^{-10}$ M or even lower. In certain embodiments, such antibodies that do not cross-react with GITR from a non-human species exhibit essentially undetectable binding against these proteins in standard binding assays.

The term "$k_{assoc}$" or "$k_a$", as used herein, is intended to refer to the association rate of a particular antibody-antigen interaction, whereas the term "$k_{dis}$" or "$k_d$," as used herein, is intended to refer to the dissociation rate of a particular antibody-antigen interaction. The term "$K_D$", as used herein, is intended to refer to the dissociation constant, which is obtained from the ratio of $k_d$ to $k_a$ (i.e., $k_d/k_a$) and is expressed as a molar concentration (M). $K_D$ values for antibodies can be determined using methods well established in the art. A preferred method for determining the $K_D$ of an antibody is by using surface plasmon resonance, preferably using a biosensor system such as a Biacore® system or flow cytometry and Scatchard analysis.

As used herein, the term "high affinity" for an IgG antibody refers to an antibody having a $K_D$ of $10^{-8}$ M or less, more preferably $10^{-9}$ M or less and even more preferably $10^{-10}$ M or less for a target antigen. However, "high affinity" binding can vary for other antibody isotypes. For example, "high affinity" binding for an IgM isotype refers to an antibody having a $K_D$ of $10^{-7}$ M or less, more preferably $10^{-8}$ M or less.

The term "EC50" in the context of an in vitro or in vivo assay using an antibody or antigen binding fragment thereof, refers to the concentration of an antibody or an antigen-binding portion thereof that induces a response that is 50% of the maximal response, i.e., halfway between the maximal response and the baseline.

The term "binds to immobilized GITR," refers to the ability of an antibody described herein to bind to GITR, for example, expressed on the surface of a cell or which is attached to a solid support.

The term "cross-reacts," as used herein, refers to the ability of an antibody described herein to bind to GITR from a different species. For example, an antibody described herein that binds human GITR may also bind another species of GITR (e.g., cynomolgus GITR). As used herein, cross-reactivity may be measured by detecting a specific reactivity with purified antigen in binding assays (e.g., SPR, ELISA) or binding to, or otherwise functionally interacting with, cells physiologically expressing GITR. Methods for determining cross-reactivity include standard binding assays as described herein, for example, by Biacore™ surface plasmon resonance (SPR) analysis using a Biacore™ 2000 SPR instrument (Biacore AB, Uppsala, Sweden), or flow cytometric techniques.

The term "naturally-occurring" as used herein as applied to an object refers to the fact that an object can be found in nature. For example, a polypeptide or polynucleotide sequence that is present in an organism (including viruses) that can be isolated from a source in nature and which has not been intentionally modified by man in the laboratory is naturally-occurring.

A "polypeptide" refers to a chain comprising at least two consecutively linked amino acid residues, with no upper limit on the length of the chain. One or more amino acid residues in the protein may contain a modification such as, but not limited to, glycosylation, phosphorylation or disulfide bond formation. A "protein" may comprise one or more polypeptides.

The term "nucleic acid molecule," as used herein, is intended to include DNA molecules and RNA molecules. A nucleic acid molecule may be single-stranded or double-stranded, and may be cDNA.

Also provided are "conservative sequence modifications" of the sequences set forth herein, e.g., in Table 15, such as in SEQ ID NOs: 13-191, i.e., nucleotide and amino acid sequence modifications which do not abrogate the binding of the antibody encoded by the nucleotide sequence or containing the amino acid sequence, to the antigen. Such conservative sequence modifications include conservative nucleotide and amino acid substitutions, as well as, nucleotide and amino acid additions and deletions. For example, modifications can be introduced into a sequence in Table 15, e.g., SEQ ID NOs: 13-191, by standard techniques known in the art, such as site-directed mutagenesis and PCR-mediated mutagenesis. Conservative amino acid substitutions include ones in which the amino acid residue is replaced with an amino acid residue having a similar side chain. Families of amino acid residues having similar side chains have been defined in the art. These families include amino acids with basic side chains (e.g., lysine, arginine, histidine), acidic side chains (e.g., aspartic acid, glutamic acid), uncharged polar side chains (e.g., glycine, asparagine, glutamine, serine, threonine, tyrosine, cysteine, tryptophan), nonpolar side chains (e.g., alanine, valine, leucine, isoleucine, proline, phenylalanine, methionine), beta-branched side chains (e.g., threonine, valine, isoleucine) and aromatic side chains (e.g., tyrosine, phenylalanine, tryptophan, histidine). Thus, a predicted nonessential amino acid residue in an anti-GITR antibody is preferably replaced with another amino acid residue from the same side chain family. Methods of identifying nucleotide and amino acid conservative substitutions which do not eliminate antigen binding are well-known in the art (see, e.g., Brummell et al., *Biochem.* 32:1180-1187

(1993); Kobayashi et al. Protein Eng. 12(10):879-884 (1999); and Burks et al. *Proc. Natl. Acad. Sci. USA* 94:412-417 (1997)). Alternatively, in another embodiment, mutations can be introduced randomly along all or part of an anti-GITR antibody coding sequence, such as by saturation mutagenesis, and the resulting modified anti-GITR antibodies can be screened for binding activity.

For nucleic acids, the term "substantial homology" indicates that two nucleic acids, or designated sequences thereof, when optimally aligned and compared, are identical, with appropriate nucleotide insertions or deletions, in at least about 80% of the nucleotides, usually at least about 90% to 95%, and more preferably at least about 98% to 99.5% of the nucleotides. Alternatively, substantial homology exists when the segments will hybridize under selective hybridization conditions, to the complement of the strand.

For polypeptides, the term "substantial homology" indicates that two polypeptides, or designated sequences thereof, when optimally aligned and compared, are identical, with appropriate amino acid insertions or deletions, in at least about 80% of the amino acids, usually at least about 90% to 95%, and more preferably at least about 98% to 99.5% of the amino acids.

The percent identity between two sequences is a function of the number of identical positions shared by the sequences (i.e., % homology=# of identical positions/total # of positions×100), taking into account the number of gaps, and the length of each gap, which need to be introduced for optimal alignment of the two sequences. The comparison of sequences and determination of percent identity between two sequences can be accomplished using a mathematical algorithm, as described in the non-limiting examples below.

The percent identity between two nucleotide sequences can be determined using the GAP program in the GCG software package (available at http://www.gcg.com), using a NWSgapdna.CMP matrix and a gap weight of 40, 50, 60, 70, or 80 and a length weight of 1, 2, 3, 4, 5, or 6. The percent identity between two nucleotide or amino acid sequences can also be determined using the algorithm of E. Meyers and W. Miller (CABIOS, 4:11-17 (1989)) which has been incorporated into the ALIGN program (version 2.0), using a PAM120 weight residue table, a gap length penalty of 12 and a gap penalty of 4. In addition, the percent identity between two amino acid sequences can be determined using the Needleman and Wunsch (*J. Mol. Biol.* (48):444-453 (1970)) algorithm which has been incorporated into the GAP program in the GCG software package (available at http://www.gcg.com), using either a Blossum 62 matrix or a PAM250 matrix, and a gap weight of 16, 14, 12, 10, 8, 6, or 4 and a length weight of 1, 2, 3, 4, 5, or 6.

The nucleic acid and protein sequences described herein can further be used as a "query sequence" to perform a search against public databases to, for example, identify related sequences. Such searches can be performed using the NBLAST and XBLAST programs (version 2.0) of Altschul, et al. (1990) *J. Mol. Biol.* 215:403-10. BLAST nucleotide searches can be performed with the NBLAST program, score=100, wordlength=12 to obtain nucleotide sequences homologous to the nucleic acid molecules described herein. BLAST protein searches can be performed with the XBLAST program, score=50, wordlength=3 to obtain amino acid sequences homologous to the protein molecules described herein. To obtain gapped alignments for comparison purposes, Gapped BLAST can be utilized as described in Altschul et al., (1997) *Nucleic Acids Res.* 25(17):3389-3402. When utilizing BLAST and Gapped BLAST programs, the default parameters of the respective programs (e.g., XBLAST and NBLAST) can be used. See www.ncbi.nlm.nih.gov.

The nucleic acids may be present in whole cells, in a cell lysate, or in a partially purified or substantially pure form. A nucleic acid is "isolated" or "rendered substantially pure" when purified away from other cellular components or other contaminants, e.g., other cellular nucleic acids (e.g., the other parts of the chromosome) or proteins, by standard techniques, including alkaline/SDS treatment, CsCl banding, column chromatography, agarose gel electrophoresis and others well known in the art. See, F. Ausubel, et al., ed. Current Protocols in Molecular Biology, Greene Publishing and Wiley Interscience, New York (1987).

Nucleic acids, e.g., cDNA, may be mutated, in accordance with standard techniques to provide gene sequences. For coding sequences, these mutations, may affect amino acid sequence as desired. In particular, DNA sequences substantially homologous to or derived from native V, D, J, constant, switches and other such sequences described herein are contemplated (where "derived" indicates that a sequence is identical or modified from another sequence).

The term "vector," as used herein, is intended to refer to a nucleic acid molecule capable of transporting another nucleic acid to which it has been linked. One type of vector is a "plasmid," which refers to a circular double stranded DNA loop into which additional DNA segments may be ligated. Another type of vector is a viral vector, wherein additional DNA segments may be ligated into the viral genome. Certain vectors are capable of autonomous replication in a host cell into which they are introduced (e.g., bacterial vectors having a bacterial origin of replication and episomal mammalian vectors). Other vectors (e.g., non-episomal mammalian vectors) can be integrated into the genome of a host cell upon introduction into the host cell, and thereby are replicated along with the host genome. Moreover, certain vectors are capable of directing the expression of genes to which they are operatively linked. Such vectors are referred to herein as "recombinant expression vectors" (or simply, "expression vectors") In general, expression vectors of utility in recombinant DNA techniques are often in the form of plasmids. In the present specification, "plasmid" and "vector" may be used interchangeably as the plasmid is the most commonly used form of vector. However, also included are other forms of expression vectors, such as viral vectors (e.g., replication defective retroviruses, adenoviruses and adeno-associated viruses), which serve equivalent functions.

The term "recombinant host cell" (or simply "host cell"), as used herein, is intended to refer to a cell that comprises a nucleic acid that is not naturally present in the cell, and may be a cell into which a recombinant expression vector has been introduced. It should be understood that such terms are intended to refer not only to the particular subject cell but to the progeny of such a cell. Because certain modifications may occur in succeeding generations due to either mutation or environmental influences, such progeny may not, in fact, be identical to the parent cell, but are still included within the scope of the term "host cell" as used herein.

As used herein, the term "antigen" refers to any natural or synthetic immunogenic substance, such as a protein, peptide, or hapten. An antigen may be GITR or a fragment thereof. An antigen may also be a tumor antigen, against which protective or therapeutic immune responses are desired, e.g., antigens expressed by a tumor cell (e.g., in a vaccine in combination with an anti-GITR antibody). Antigens include tumor-associated antigens for the prevention or treatment of cancers. Examples of tumor-associated antigens include, but are not limited to, sequences comprising all or part of the sequences of βhCG, gp100 or Pmel17, HER2/neu, WT1, mesothelin, CEA, gp100, MART1, TRP-2, melan-A, NY-ESO-1, NY-BR-1, NY-CO-58, MN (gp250) and idiotype, MAGE-1, MAGE-3, MAGE-A3, Tyrosinase, Telomerase, SSX2 and MUC-1 antigens, and germ cell derived tumor antigens. Tumor associated antigens also include the blood group antigens, for example, Le$^a$, Le$^b$, LeX, LeY, H-2, B-1, B-2 antigens. Alternatively, more than one antigen can be included in a construct. For example, a MAGE antigen can be combined with other antigens such as melanin A, tyrosinase, and gp100 along with adjuvants such as GM-CSF or IL-12, and linked to an anti-APC antibody.

Sequences of the foregoing antigens are well known in the art. For example, an example of a MAGE-3 cDNA sequence is provided in U.S. Pat. No. 6,235,525 (Ludwig Institute for Cancer Research); examples of NY-ESO-1 nucleic acid and protein sequences are provided in U.S. Pat. Nos. 5,804,381 and 6,069,233 (Ludwig Institute for Cancer Research); examples of Melan-A nucleic acid and protein sequences are provided in U.S. Pat. Nos. 5,620,886 and 5,854,203 (Ludwig Institute for Cancer Research); examples of NY-BR-1 nucleic acid and protein sequences are provided in U.S. Pat. Nos. 6,774,226 and 6,911,529 (Ludwig Institute for Cancer Research) and examples of NY-CO-58 nucleic acid and protein sequences are provided in WO 02090986 (Ludwig Institute for Cancer Research); an example of an amino acid sequence for the HER-2/neu protein is available at GENBANK® Accession No. AAA58637; and a nucleotide sequence (mRNA) for human carcinoembryonic antigen-like 1 (CEA-1) is available at GENBANK® Accession No. NM020219.

An "immune response" refers to a biological response within a vertebrate against foreign agents, which response protects the organism against these agents and diseases caused by them. An immune response is mediated by the action of a cell of the immune system (for example, a T lymphocyte, B lymphocyte, natural killer (NK) cell, macrophage, eosinophil, mast cell, dendritic cell or neutrophil) and soluble macromolecules produced by any of these cells or the liver (including antibodies, cytokines, and complement) that results in selective targeting, binding to, damage to, destruction of, and/or elimination from the vertebrate's body of invading pathogens, cells or tissues infected with pathogens, cancerous or other abnormal cells, or, in cases of autoimmunity or pathological inflammation, normal human cells or tissues. An immune reaction includes, e.g., activation or inhibition of a T cell, e.g., an effector T cell or a Th cell, such as a CD4+ or CD8+ T cell, or the inhibition of a Treg cell.

An "immunomodulator" or "immunoregulator" refers to an agent, e.g., a component of a signaling pathway, that may be involved in modulating, regulating, or modifying an immune response. "Modulating," "regulating," or "modifying" an immune response refers to any alteration in a cell of the immune system or in the activity of such cell (e.g., an effector T cell). Such modulation includes stimulation or suppression of the immune system which may be manifested by an increase or decrease in the number of various cell types, an increase or decrease in the activity of these cells, or any other changes which can occur within the immune system. Both inhibitory and stimulatory immunomodulators have been identified, some of which may have enhanced function in a tumor microenvironment. In preferred embodiments, the immunomodulator is located on the surface of a T cell. An "immunomodulatory target" or "immunoregula-tory target" is an immunomodulator that is targeted for binding by, and whose activity is altered by the binding of, a substance, agent, moiety, compound or molecule. Immunomodulatory targets include, for example, receptors on the surface of a cell ("immunomodulatory receptors") and receptor ligands ("immunomodulatory ligands").

"Immunotherapy" refers to the treatment of a subject afflicted with, or at risk of contracting or suffering a recurrence of, a disease by a method comprising inducing, enhancing, suppressing or otherwise modifying an immune response.

"Immunostimulating therapy" or "immunostimulatory therapy" refers to a therapy that results in increasing (inducing or enhancing) an immune response in a subject for, e.g., treating cancer.

"Potentiating an endogenous immune response" means increasing the effectiveness or potency of an existing immune response in a subject. This increase in effectiveness and potency may be achieved, for example, by overcoming mechanisms that suppress the endogenous host immune response or by stimulating mechanisms that enhance the endogenous host immune response.

"T effector" ("$T_{eff}$") cells refers to T cells (e.g., CD4+ and CD8+ T cells) with cytolytic activities as well as T helper (Th) cells, which secrete cytokines and activate and direct other immune cells, but does not include regulatory T cells (Treg cells). Anti-GITR antibodies described herein activate $T_{eff}$ cells, e.g., CD4+ and CD8+ $T_{eff}$ cells.

An increased ability to stimulate an immune response or the immune system, can result from an enhanced agonist activity of T cell costimulatory receptors and/or an enhanced antagonist activity of inhibitory receptors. An increased ability to stimulate an immune response or the immune system may be reflected by a fold increase of the $EC_{50}$ or maximal level of activity in an assay that measures an immune response, e.g., an assay that measures changes in cytokine or chemokine release, cytolytic activity (determined directly on target cells or indirectly via detecting CD107a or granzymes) and proliferation. The ability to stimulate an immune response or the immune system activity may be enhanced by at least 10%, 30%, 50%, 75%, 2 fold, 3 fold, 5 fold or more.

In certain embodiments, an antibody comprising a modified heavy chain constant region has more potent agonist activity, relative to the same antibody that does not comprise a modified heavy chain constant region. The enhanced agonist activity of an antibody can be determined, e.g., as shown in the Examples, e.g., by measuring the level of IFN-γ or IL-2 secretion from T cells that are contacted with the antibody. The agonist activity may be enhanced by at least 10%, 30%, 50%, 75%, 2 fold, 3 fold, 5 fold or more as defined by increased cytokine release or increased proliferation in effector T cells; reduced T regulatory cell activity if engagement on Tregs reduces Treg function; or increased depletion of Tregs. For example, the amount of IFN-γ or IL-2 secreted from T cells stimulated with an antibody comprising a modified heavy chain constant region may be at least 10%, 30%, 50%, 75%, 2 fold, 3 fold, 5 fold or more higher than that of T cells simulated with the same antibody that does not comprise a modified heavy chain constant region.

As used herein, the term "linked" refers to the association of two or more molecules. The linkage can be covalent or non-covalent. The linkage also can be genetic (i.e., recombinantly fused). Such linkages can be achieved using a wide variety of art recognized techniques, such as chemical conjugation and recombinant protein production.

As used herein, "administering" refers to the physical introduction of a composition comprising a therapeutic agent to a subject, using any of the various methods and delivery systems known to those skilled in the art. Preferred routes of administration for antibodies described herein include intravenous, intraperitoneal, intramuscular, subcutaneous, spinal or other parenteral routes of administration, for example by injection or infusion. The phrase "parenteral administration" as used herein means modes of administration other than enteral and topical administration, usually by injection, and includes, without limitation, intravenous, intraperitoneal, intramuscular, intraarterial, intrathecal, intralymphatic, intralesional, intracapsular, intraorbital, intracardiac, intradermal, transtracheal, subcutaneous, subcuticular, intraarticular, subcapsular, subarachnoid, intraspinal, epidural and intrasternal injection and infusion, as well as in vivo electroporation. Alternatively, an antibody described herein can be administered via a non-parenteral route, such as a topical, epidermal or mucosal route of administration, for example, intranasally, orally, vaginally, rectally, sublingually or topically. Administering can also be performed, for example, once, a plurality of times, and/or over one or more extended periods.

As used herein, the term "T cell-mediated response" refers to a response mediated by T cells, including effector T cells (e.g., $CD8^+$ cells) and helper T cells (e.g., $CD4^+$ cells). T cell mediated responses include, for example, T cell cytotoxicity and proliferation.

As used herein, the term "cytotoxic T lymphocyte (CTL) response" refers to an immune response induced by cytotoxic T cells. CTL responses are mediated primarily by $CD8^+$ T cells.

As used herein, the terms "inhibits" or "blocks" (e.g., referring to inhibition/blocking of binding of GITR-L to GITR on cells) are used interchangeably and encompass both partial and complete inhibition/blocking. In some embodiments, the anti-GITR antibody inhibits binding of GITR-L to GITR by at least about 50%, for example, about 60%, 70%, 80%, 90%, 95%, 99%, or 100%, determined, e.g., as further described herein. In some embodiments, the anti-GITR antibody inhibits binding of GITR-L to GITR by no more than 50%, for example, by about 40%, 30%, 20%, 10%, 5% or 1%, determined, e.g., as further described herein.

As used herein, the term "inhibits growth" of a tumor includes any measurable decrease in the growth of a tumor, e.g., the inhibition of growth of a tumor by at least about 10%, for example, at least about 20%, at least about 30%, at least about 40%, at least about 50%, at least about 60%, at least about 70%, at least about 80%, at least about 90%, at least about 99%, or 100%.

As used herein, "cancer" refers a broad group of diseases characterized by the uncontrolled growth of abnormal cells in the body. Unregulated cell division may result in the formation of malignant tumors or cells that invade neighboring tissues and may metastasize to distant parts of the body through the lymphatic system or bloodstream.

The terms "treat," "treating," and "treatment," as used herein, refer to any type of intervention or process performed on, or administering an active agent to, the subject with the objective of reversing, alleviating, ameliorating, inhibiting, or slowing down or preventing the progression, development, severity or recurrence of a symptom, complication, condition or biochemical indicia associated with a disease. Treatment can be of a subject having a disease or a subject who does not have a disease (e.g., for prophylaxis).

A "hematological malignancy" includes a lymphoma, leukemia, myeloma or a lymphoid malignancy, as well as a cancer of the spleen and the lymph nodes. Exemplary lymphomas include both B cell lymphomas (a B-cell hematological cancer) and T cell lymphomas. B-cell lymphomas include both Hodgkin's lymphomas and most non-Hodgkin's lymphomas. Non-limiting examples of B cell lymphomas include diffuse large B-cell lymphoma, follicular lymphoma, mucosa-associated lymphatic tissue lymphoma, small cell lymphocytic lymphoma (overlaps with chronic lymphocytic leukemia), mantle cell lymphoma (MCL), Burkitt's lymphoma, mediastinal large B cell lymphoma, Waldenström macroglobulinemia, nodal marginal zone B cell lymphoma, splenic marginal zone lymphoma, intravascular large B-cell lymphoma, primary effusion lymphoma, lymphomatoid granulomatosis. Non-limiting examples of T cell lymphomas include extranodal T cell lymphoma, cutaneous T cell lymphomas, anaplastic large cell lymphoma, and angioimmunoblastic T cell lymphoma. Hematological malignancies also include leukemia, such as, but not limited to, secondary leukemia, chronic lymphocytic leukemia, acute myelogenous leukemia, chronic myelogenous leukemia, and acute lymphoblastic leukemia. Hematological malignancies further include myelomas, such as, but not limited to, multiple myeloma and smoldering multiple myeloma. Other hematological and/or B cell- or T-cell-associated cancers are encompassed by the term hematological malignancy.

The term "effective dose" or "effective dosage" is defined as an amount sufficient to achieve or at least partially achieve a desired effect. A "therapeutically effective amount" or "therapeutically effective dosage" of a drug or therapeutic agent is any amount of the drug that, when used alone or in combination with another therapeutic agent, promotes disease regression evidenced by a decrease in severity of disease symptoms, an increase in frequency and duration of disease symptom-free periods, or a prevention of impairment or disability due to the disease affliction. A therapeutically effective amount or dosage of a drug includes a "prophylactically effective amount" or a "prophylactically effective dosage", which is any amount of the drug that, when administered alone or in combination with another therapeutic agent to a subject at risk of developing a disease or of suffering a recurrence of disease, inhibits the development or recurrence of the disease. The ability of a therapeutic agent to promote disease regression or inhibit the development or recurrence of the disease can be evaluated using a variety of methods known to the skilled practitioner, such as in human subjects during clinical trials, in animal model systems predictive of efficacy in humans, or by assaying the activity of the agent in in vitro assays.

By way of example, an anti-cancer agent is a drug that promotes cancer regression in a subject. In preferred embodiments, a therapeutically effective amount of the drug promotes cancer regression to the point of eliminating the cancer. "Promoting cancer regression" means that administering an effective amount of the drug, alone or in combination with an anti-neoplastic agent, results in a reduction in tumor growth or size, necrosis of the tumor, a decrease in severity of at least one disease symptom, an increase in frequency and duration of disease symptom-free periods, a prevention of impairment or disability due to the disease affliction, or otherwise amelioration of disease symptoms in the patient. In addition, the terms "effective" and "effectiveness" with regard to a treatment includes both pharmacological effectiveness and physiological safety. Pharmacological effectiveness refers to the ability of the drug to promote cancer regression in the patient. Physiological safety refers to the level of toxicity, or other adverse physiological effects at the cellular, organ and/or organism level (adverse effects) resulting from administration of the drug.

By way of example for the treatment of tumors, a therapeutically effective amount or dosage of the drug preferably inhibits cell growth or tumor growth by at least about 20%, more preferably by at least about 40%, even more preferably by at least about 60%, and still more preferably by at least about 80% relative to untreated subjects. In the most preferred embodiments, a therapeutically effective amount or dosage of the drug completely inhibits cell growth or tumor growth, i.e., preferably inhibits cell growth or tumor growth by 100%. The ability of a compound to inhibit tumor growth can be evaluated using the assays described infra. Alternatively, this property of a composition can be evaluated by examining the ability of the compound to inhibit cell growth, such inhibition can be measured in vitro by assays known to the skilled practitioner. In other preferred embodiments described herein, tumor regression may be observed and continue for a period of at least about 20 days, more preferably at least about 40 days, or even more preferably at least about 60 days.

The term "patient" includes human and other mammalian subjects that receive either prophylactic or therapeutic treatment.

As used herein, the term "subject" includes any human or non-human animal. For example, the methods and compositions described herein can be used to treat a subject having cancer. The term "non-human animal" includes all vertebrates, e.g., mammals and non-mammals, such as non-human primates, sheep, dog, cow, chickens, amphibians, reptiles, etc.

As used herein, the terms "ug" and "uM" are used interchangeably with "μg" and "μM".

Various aspects described herein are described in further detail in the following subsections.

I. Anti-GITR Antibodies

Described herein are antibodies, e.g., fully human antibodies, which are characterized by particular functional features or properties. For example, the antibodies specifically bind human GITR. Additionally, antibodies may cross react with GITR from one or more non-human primates, such as cynomolgus GITR.

In addition to binding specifically to soluble and/or membrane bound human GITR, the antibodies described herein exhibit one or more of the following functional properties:

(a) binding to cynomolgus GITR;
(b) stimulating or enhancing an immune response;
(c) activating T cells (as evidenced, e.g., by enhanced cytokine secretion and/or proliferation);
(d) inhibiting binding of GITRL to GITR on 3A9-hGITR cells;
(e) at most partially inhibiting the binding of GITR ligand to GITR on activated T cells;
(f) binding to a conformational epitope in the N-terminal portion of human GITR;
(g) binding to both glycosylated and unglycosylated human GITR; and
(h) having agonist activity in the absence of binding to an Fc receptor, but wherein binding to an Fc receptor further enhances the agonist activity.

Preferably, anti-GITR antibodies bind to GITR with high affinity, for example, with a $K_D$ of $10^{-7}$ M or less, $10^{-8}$ M or less, $10^{-9}$ M or less, $10^{-10}$ M or less, $10^{-11}$ M or less, $10^{-12}$ M or less, $10^{-12}$ M to $10^{-7}$ M, $10^{-11}$ M to $10^{-7}$ M, $10^{-10}$ M to $10^{-7}$ M, or $10^{-9}$ M to $10^{-7}$ M. In certain embodiments, an anti-GITR antibody binds to soluble human GITR, e.g., as determined by Biacore, with a $K_D$ of $10^{-7}$ M or less, $10^{-8}$ M or less, $10^{-9}$ M (1 nM) or less, $10^{-10}$ M or less, $10^{-12}$ M to $10^{-7}$ M, $10^{-11}$ M to $10^{-7}$ M, $10^{-10}$ M to $10^{-7}$ M, $10^{-9}$ M to $10^{-7}$ M, or $10^{-8}$ M to $10^{-7}$ M. In certain embodiments, an anti-GITR antibody binds to bound (e.g., cell membrane bound) human GITR, such as on activated human T cells, e.g., as determined by flow cytometry and Scatchard plot, with a $K_D$ of $10^{-7}$ M or less, $10^{-8}$ M or less, $10^{-9}$ M (1 nM) or less, $10^{-10}$ M or less, $10^{-12}$ M to $10^{-7}$ M, $10^{-11}$ M to $10^{-8}$ M, $10^{-10}$ M to $10^{-8}$ M, $10^{-9}$ M to $10^{-8}$ M, $10^{-11}$ M to $10^{-9}$ M, or $10^{-10}$ M to $10^{-9}$ M. In certain embodiments, an anti-GITR antibody binds to bound (e.g., cell membrane bound) human GITR, such as on activated human T cells, e.g., as determined by FACS, with an $EC_{50}$ of $10^{-7}$ M or less, $10^{-8}$ M or less, $10^{-9}$ M (1 nM) or less, $10^{-10}$ M or less, $10^{-12}$ M to $10^{-7}$ M, $10^{-11}$ M to $10^{-8}$ M, $10^{-10}$ M to $10^{-8}$ M, $10^{-9}$ M to $10^{-8}$ M, $10^{-11}$ M to $10^{-9}$ M, or $10^{-10}$ M to $10^{-9}$ M. In certain embodiments, an anti-GITR antibody binds to soluble human GITR with a $K_D$ of $10^{-7}$ M or less, $10^{-8}$ M or less, $10^{-9}$ M (1 nM) or less, $10^{-10}$ M or less, $10^{-12}$ M to $10^{-7}$ M, $10^{-11}$ M to $10^{-10}$ M, $10^{-10}$ M to $10^{-7}$ M, $10^{-9}$ M to $10^{-7}$ M, or $10^{-8}$ M to $10^{-7}$ M, and to cell membrane bound human GITR with a $K_D$ or $EC_{50}$ of $10^{-7}$ M or less, $10^{-8}$ M or less, $10^{-9}$ M (1 nM) or less, $10^{-10}$ M or less, $10^{-12}$ M to $10^{-7}$ M, $10^{-11}$ M to $10^{-8}$ M, $10^{-10}$ M to $10^{-8}$ M, $10^{-9}$ M to $10^{-8}$ M, $10^{-11}$ M to $10^{-9}$ M, or $10^{-10}$ M to $10^{-9}$ M.

Anti-GITR antibodies may bind to cynomolgus GITR, e.g., bind to membrane bound cynomolgus GITR, e.g., with an $EC_{50}$ of 100 nM or less, 10 nM or less, 100 nM to 0.01 nM, 100 nM to 0.1 nM, 100 nM to 1 nM, or 10 nM to 1 nM, e.g., as measured by FACS (e.g., as described in the Examples).

Anti-GITR antibodies may stimulate or enhance an immune response, e.g., by activating $T_{eff}$ cells, limiting the suppression of Teffector cells by Treg cells, depleting and/or inhibiting tumor Treg cells and/or activating NK cells, e.g., in the tumor. For example, the anti-GITR antibodies may activate or costimulate $T_{eff}$ cells as evidenced, e.g., by enhanced cytokine (e.g., IL-2 and IFN-γ) secretion and/or enhanced proliferation. In certain embodiments, CD3 stimulation is also provided. In certain embodiments, a GITR antibody increases IL-2 secretion by a factor of 50%, 100% (i.e., 2 fold), 3 fold, 4 fold, 5 fold or more, optionally with a maximum of up to 10 fold, 30 fold, 100 fold, as measured, e.g., on primary human T cells or T cells expressing human GITR (e.g., as further described in the Examples). In certain embodiments, a GITR antibody increases IFN-γ secretion by a factor of 50%, 100% (i.e., 2 fold), 3 fold, 4 fold, 5 fold or more, optionally with a maximum of up to 10 fold, 30 fold, 100 fold, as measured, e.g., on primary human T cells or T cells expressing human GITR (e.g., as further described in the Examples).

Anti-GITR antibodies may inhibit binding of human GITRL to human GITR on cells, e.g., 3A9 cells expressing human GITR, e.g., with an $EC_{50}$ of 10 μg/ml or less, 1 μg/ml or less, 0.01 μg/ml to 10 μg/ml, 0.1 μg/ml to 10 μg/ml, or 0.1 μg/ml to 1 μg/ml (see Example 5).

In certain embodiments, anti-GITR antibodies at most only partially inhibit binding of human GITRL to human GITR on cells, e.g., activated T cells (see Example 5).

Anti-GITR antibodies may bind to an epitope, e.g., a conformational epitope in the N-terminal portion of human GITR, e.g., an epitope located within amino acids 1 to 39 of mature human GITR (see Example 9), as determined, e.g., by binding of the antibodies to fragments of human GITR, e.g., native (i.e., non-denatured) fragments of human GITR. Anti-GITR antibodies may bind to, or to an epitope located within, amino acids 1 to 20 of mature human GITR, as determined, e.g., by binding of the antibodies to fragments of human GITR, e.g., native (i.e., non-denatured) fragments of human GITR, followed by enzymatic cleavage or by HDX (see Examples 11 and 12, respectively). Anti-GITR antibodies may bind to, or to an epitope within, amino acids 3 to 20 of mature human GITR (PTGGPGCGPGRLLLGTGT, SEQ ID NO: 217). Anti-GITR antibodies may bind to, or to an epitope within, amino acids 3 to 20 and amino acids 33 to 40 of mature human GITR, i.e., amino acid sequences PTGGPGCGPGRLLLGTGT (SEQ ID NO: 217) and CRDYPGEE (SEQ ID NO: 218). In certain embodiments, anti-GITR antibodies bind to both glycosylated and unglycosylated human GITR. In certain embodiments, anti-GITR antibodies bind to amino acid sequences PTGGPGCGPGRLLLGTGT (SEQ ID NO: 217) and CRDYPGEE (SEQ ID NO: 218), as determined by HDX, e.g., using the protocol set forth in the Examples.

Anti-GITR antibodies may compete for binding to GITR with (or inhibit binding of) anti-GITR antibodies comprising CDRs or variable regions described herein, e.g., 28F3, 3C3-1, 3C3-2, 2G6, 8A6, 9G7-1, 9G7-2, 14E3, 19H8-1, 19H8-2, 19D3, 18E10, and/or 6G10. In certain embodiments, anti-GITR antibodies inhibit binding of 28F3, 3C3, 2G6, 8A6, 9G7, 14E3, 19H8, 19D3, 18E10, and/or 6G10 to human GITR by at least 10%, 20%, 30%, 40%, 50%, 60%, 70%, 80%, 90% or by 100%. In certain embodiments, 28F3, 3C3-1, 3C3-2, 2G6, 8A6, 9G7-1, 9G7-2, 14E3, 19H8-1, 19H8-2, 19D3, 18E10, and/or 6G10 inhibit binding of anti-GITR antibodies to human GITR by at least 10%, 20%, 30%, 40%, 50%, 60%, 70%, 80%, 90% or by 100%. In certain embodiments, anti-GITR antibodies inhibit binding of 28F3, 3C3-1, 3C3-2, 2G6, 8A6, 9G7-1, 9G7-2, 14E3, 19H8-1, 19H8-2, 19D3, 18E10, and/or 6G10 to human GITR by at least 10%, 20%, 30%, 40%, 50%, 60%, 70%, 80%, 90% or by 100% and 28F3, 3C3-1, 3C3-2, 2G6, 8A6, 9G7-1, 9G7-2, 14E3, 19H8-1, 19H8-2, 19D3, 18E10, and/or 6G10 inhibit binding of the anti-GITR antibodies to human GITR by at least 10%, 20%, 30%, 40%, 50%, 60%, 70%, 80%, 90% or by 100% (e.g., compete in both directions).

In certain embodiments, anti-GITR antibodies induce or enhance T cell activation without requiring multivalent cross-linking, as determined, e.g., by the lack of requirement of FcR binding. In certain embodiments, anti-GITR antibodies are multivalent, e.g., bivalent. In certain embodiments, anti-GITR antibodies are not monovalent. It has been shown herein that F'(ab)2 fragments are more effective than Fab fragments at activating T cells (see, Examples).

In certain embodiments, anti-GITR antibodies do not require cross-linking via Fc receptors for their agonist activity, however, cross-linking to Fc receptors enhances their agonist activity relative to the same antibody that does not bind to Fc receptors.

In certain embodiments, anti-GITR antibodies have 1, 2, 3, 4, 5, 6, 7, 8, 9, 10, 11, or 12 of the following features:
(1) binding to soluble human GITR, e.g., with a $K_D$ of 10 nM or less (e.g., 0.01 nM to 10 nM), e.g., as measured by Biacore;
(2) binding to membrane bound human GITR, e.g., with a $K_D$ of 1 nM or less (e.g., 0.01 nM to 1 nM), e.g., as measured by Scatchard;
(3) binding to membrane bound human GITR, e.g., with an $EC_{50}$ of 1 nM or less (e.g., 0.01 nM to 1 nM), e.g., as measured by FACS;
(4) binding to cynomolgus GITR, e.g., binding to membrane bound cynomolgus GITR, e.g., with an $EC_{50}$ of 10 nM or less (e.g., 0.01 nM to 10 nM), e.g., as measured by FACS;
(5) inducing or enhancing T cell activation, such as in the presence of CD3 engagement (e.g., in the presence of suboptimal anti-CD3 concentrations), as evidenced by (i) increased IL-2 and/or IFN-γ production in GITR-expressing T cells and/or (ii) enhanced T cell proliferation;
(6) inducing or enhancing T cell activation without requiring multivalent cross-linking;
(7) having agonist activity in the absence of binding to an Fc receptor, but wherein binding to an Fc receptor further enhances the agonist activity;
(8) inhibiting the binding of GITR ligand to GITR, e.g., with an $EC_{50}$ of 1 μg/mL or less as measured by FACS, e.g., in an assay with 3A9-hGITR cells;
(9) at most partially inhibiting the binding of GITR ligand to GITR on activated T cells;
(10) binding to a conformational epitope on mature human GITR (SEQ ID NO: 4), e.g., a discontinuous epitope within the amino acid sequences PTGGPGCGPGRLLLGTGT (SEQ ID NO: 217) and CRDYPGEE (SEQ ID NO: 218);
(11) binding to both O-linked and N-linked glycosylated and unglycosylated human GITR; and
(12) competing in either direction or both directions for binding to human GITR with 28F3, 3C3-1, 3C3-2, 2G6, 8A6, 9G7-1, 9G7-2, 14E3, 19H8-1, 19H8-2, 19D3, 18E10, and/or 6G10.

Anti-GITR antibodies may also induce internalization of GITR in activated T cells, e.g., CD4+ and CD8+ T cells, e.g., within 10, 30 or 60 minutes, and subsequent signal transduction, e.g., activation (i.e., phosphorylation) of p65 NF-kB and p38 MAPkinase.

Accordingly, an antibody that exhibits one or more of these functional properties (e.g., biochemical, immunochemical, cellular, physiological or other biological activities, or the like) as determined according to methodologies known to the art and described herein, will be understood to relate to a statistically significant difference in the particular activity relative to that seen in the absence of the antibody (e.g., or when a control antibody of irrelevant specificity is present). Preferably, anti-GITR antibody-induced increases in a measured parameter (e.g., T cell proliferation, cytokine production) effects a statistically significant increase by at least 10% of the measured parameter, more preferably by at least 20%, 30%, 40%, 50%, 60%, 70%, 80%, 90%, 95%, 100% (i.e., 2 fold), 3 fold, 5 fold or 10 fold, and in certain preferred embodiments, an antibody described herein may increase the measured parameter by greater than 92%, 94%, 95%, 97%, 98%, 99%, 100% (i.e, 2 fold), 3 fold, 5 fold or 10 fold. Conversely, anti-GITR antibody-induced decreases in a measured parameter (e.g., tumor volume, GITR-L binding to GITR, quantity of regulatory T cells in tumors) effects a statistically significant decrease by at least 10% of the measured parameter, more preferably by at least 20%, 30%, 40%, 50%, 60%, 70%, 80% or 90%, and in certain preferred embodiments, an antibody described herein may decrease the measured parameter by greater than 92%, 94%, 95%, 97%, 98% or 99%.

Standard assays to evaluate the binding ability of the antibodies toward GITR of various species are known in the art, including for example, ELISAs, Western blots, and RIAs. Suitable assays are described in detail in the Examples. The binding kinetics (e.g., binding affinity) of the antibodies also can be assessed by standard assays known in the art, such as by Biacore analysis. Assays to evaluate the effects of the antibodies on functional properties of GITR (e.g., ligand binding, T cell proliferation, cytokine production) are described in further detail infra and in the Examples.

In certain embodiments, anti-GITR antibodies are not native antibodies or are not naturally-occurring antibodies. For example, anti-GITR antibodies have post-translational modifications that are different from those of antibodies that are naturally occurring, such as by having more, less or a different type of post-translational modification.

II. Exemplary Anti-GITR Antibodies

Particular antibodies described herein are antibodies, e.g., monoclonal antibodies, having the CDR and/or variable region sequences of antibodies 28F3, 19D3, 18E10, 3C3, 2G6, 8A6, 9G7, 14E3, 19H8, and 6G10, isolated and structurally characterized as described in Example 1, as well as antibodies having at least 80% identity (e.g., at least 85%, at least 90%, at least 95%, or at least 99% identity) to their variable region or CDR sequences. The $V_H$ amino acid sequences of 28F3, 19D3, 18E10, 3C3 (3C3-1 and 3C3-2), 2G6, 8A6, 9G7 (9G7-1 and 9G7-2), 14E3, 19H8 (19H8-1 and 19H8-2), and 6G10 are set forth in SEQ ID NOs: 13, 26, 39, 52, 71, 84, 97, 115, 128, and 335, respectively. The $V_L$ amino acid sequences of 28F3, 19D3, 18E10, 3C3-1, 3C3-2, 2G6, 8A6, 9G7-1, 9G7-2, 14E3, 19H8-1, 19H8-2, and 6G10 are shown in SEQ ID NOs: 14, 27, 40, 53, 54, 72, 85, 98, 99, 116, 129, 130, and 336, respectively.

Accordingly, provided herein are isolated antibodies, or antigen binding portion thereof, comprising heavy and light chain variable regions, wherein the heavy chain variable region comprises an amino acid sequence selected from the group consisting of SEQ ID NOs: 13, 26, 39, 52, 71, 84, 97, 115, 128, and 335.

Also provided are isolated antibodies, or antigen binding portions thereof, comprising heavy and light chain variable regions, wherein the light chain variable region comprises an amino acid sequence selected from the group consisting of SEQ ID NOs: 14, 27, 40, 53, 54, 72, 85, 98, 99, 116, 129, 130, and 336.

Provided herein are isolated antibodies, or antigen-binding portion thereof, comprising:

(a) heavy and light chain variable region sequences comprising SEQ ID NOs: 13 and 14, respectively;

(b) heavy and light chain variable region sequences comprising SEQ ID NOs: 26 and 27, respectively;

(c) heavy and light chain variable region sequences comprising SEQ ID NOs: 39 and 40, respectively;

(d) heavy and light chain variable region sequences comprising SEQ ID NOs: 52 and 53, respectively;

(e) heavy and light chain variable region sequences comprising SEQ ID NOs: 52 and 54, respectively;

(f) heavy and light chain variable region sequences comprising SEQ ID NOs: 71 and 72, respectively;

(g) heavy and light chain variable region sequences comprising SEQ ID NOs: 84 and 85, respectively;

(h) heavy and light chain variable region sequences comprising SEQ ID NOs: 97 and 98, respectively;

(i) heavy and light chain variable region sequences comprising SEQ ID NOs: 97 and 99, respectively;

(j) heavy and light chain variable region sequences comprising SEQ ID NOs: 115 and 116, respectively;

(k) heavy and light chain variable region sequences comprising SEQ ID NOs: 128 and 129, respectively;

(l) heavy and light chain variable region sequences comprising SEQ ID NOs: 128 and 130, respectively; or (m) heavy and light chain variable region sequences comprising SEQ ID NOs: 335 and 336, respectively.

Anti-GITR antibodies may comprise the heavy and light chain CDR1s, CDR2s and CDR3s of 28F3, 19D3, 18E10, 3C3-1, 3C3-2, 2G6, 8A6, 9G7-1, 9G7-2, 14E3, 19H8-1, 19H8-2, and 6G10, or combinations thereof. The amino acid sequences of the $V_H$ CDR1s of 28F3, 19D3, 18E10, 3C3 (3C3-1 and 3C3-2), 2G6, 8A6, 9G7 (9G7-1 and 9G7-2), 14E3, 19H8 (19H8-1 and 19H8-2), and 6G10 are set forth in SEQ ID NOs: 20, 33, 46, 62, 78, 91, 106, 122, 138, and 342, respectively. The amino acid sequences of the $V_H$ CDR2s of 28F3, 19D3, 18E10, 3C3 (3C3-1 and 3C3-2), 2G6, 8A6, 9G7 (9G7-1 and 9G7-2), 14E3, 19H8 (19H8-1 and 19H8-2), and 6G10 are set forth in SEQ ID NOs: 21, 34, 47, 63, 79, 92, 107, 123, 139, and 343, respectively. The amino acid sequences of the $V_H$ CDR3s of 28F3, 19D3, 18E10, 3C3 (3C3-1 and 3C3-2), 2G6, 8A6, 9G7 (9G7-1 and 9G7-2), 14E3, 19H8 (19H8-1 and 19H8-2), and 6G10 are set forth in SEQ ID NOs: 22, 35, 48, 64, 80, 93, 108, 124, 140, and 344. The amino acid sequences of the $V_L$ CDR1s of 28F3, 19D3, 18E10, 3C3-1, 3C3-2, 2G6, 8A6, 9G7-1, 9G7-2, 14E3, 19H8-1, 19H8-2, and 6G10 are set forth in SEQ ID NOs: 23, 36, 49, 65, 68, 81, 94, 109, 112, 125, 141, 144, and 345, respectively. The amino acid sequences of the $V_L$ CDR2s of 28F3, 19D3, 18E10, 3C3-1, 3C3-2, 2G6, 8A6, 9G7-1, 9G7-2, 14E3, 19H8-1, 19H8-2, and 6G10 are set forth in SEQ ID NOs: 24, 37, 50, 66, 69, 82, 95, 110, 113, 126, 142, 145, and 346, respectively. The amino acid sequences of the $V_L$ CDR3s of 28F3, 19D3, 18E10, 3C3-1, 3C3-2, 2G6, 8A6, 9G7-1, 9G7-2, 14E3, 19H8-1, 19H8-2, and 6G10 are set forth in SEQ ID NOs: 25, 38, 51, 67, 70, 83, 96, 111, 114, 127, 143, 146, and 347, respectively. The CDR regions are delineated using the Kabat system (Kabat, E. A., et al. (1991) Sequences of Proteins of Immunological Interest, Fifth Edition, U.S. Department of Health and Human Services, NIH Publication No. 91-3242).

Given that each of these antibodies bind to GITR and that antigen-binding specificity is provided primarily by the CDR1, 2 and 3 regions, the $V_H$ CDR1, 2 and 3 sequences and $V_L$ CDR1, 2 and 3 sequences can be "mixed and matched" (i.e., CDRs from different antibodies can be mixed and match, although each antibody must contain a $V_H$ CDR1, 2 and 3 and a $V_L$ CDR1, 2 and 3) to create other anti-GITR binding molecules described herein. GITR binding of such "mixed and matched" antibodies can be tested using the binding assays described above and in the Examples (e.g., ELISAs). Preferably, when $V_H$ CDR sequences are mixed and matched, the CDR1, CDR2 and/or CDR3 sequence from a particular $V_H$ sequence is replaced with a structurally similar CDR sequence(s). Likewise, when $V_L$ CDR sequences are mixed and matched, the CDR1, CDR2 and/or CDR3 sequence from a particular $V_L$ sequence preferably is replaced with a structurally similar CDR sequence(s). It will be readily apparent to the ordinarily skilled artisan that novel $V_H$ and $V_L$ sequences can be created by substituting one or more $V_H$ and/or $V_L$ CDR region sequences with structurally similar sequences from the CDR sequences disclosed herein for monoclonal antibodies 28F3, 19D3, 18E10, 3C3-1, 3C3-2, 2G6, 8A6, 9G7-1, 9G7-2, 14E3, 19H8-1, 19H8-2, and 6G10.

Provided herein are isolated antibodies, or antigen binding portion thereof comprising:

(a) a heavy chain variable region CDR1 comprising an amino acid sequence selected from the group consisting of SEQ ID NOs: 20, 33, 46, 62, 78, 91, 106, 122, 138, and 342;

(b) a heavy chain variable region CDR2 comprising an amino acid sequence selected from the group consisting of SEQ ID NOs: 21, 34, 47, 63, 79, 92, 107, 123, 139, and 343;

(c) a heavy chain variable region CDR3 comprising an amino acid sequence selected from the group consisting of SEQ ID NOs: 22, 35, 48, 64, 80, 93, 108, 124, 140, and 344;

(d) a light chain variable region CDR1 comprising an amino acid sequence selected from the group consisting of SEQ ID NOs: 23, 36, 49, 65, 68, 81, 94, 109, 112, 125, 141, 144, and 345;

(e) a light chain variable region CDR2 comprising an amino acid sequence selected from the group consisting of SEQ ID NOs: 24, 37, 50, 66, 69, 82, 95, 110, 113, 126, 142, 145, and 346; and (f) a light chain variable region CDR3 comprising an amino acid sequence selected from the group consisting of SEQ ID NOs: 25, 38, 51, 67, 70, 83, 96, 111, 114, 127, 143, 146, and 347;

wherein the antibody specifically binds to human GITR.

In one embodiment, the antibody comprises heavy and light chain variable regions, wherein the heavy chain variable region CDR1, CDR2, and CDR3 regions comprise:

(a) SEQ ID NOs: 20-22;
(b) SEQ ID NOs: 33-35;
(c) SEQ ID NOs: 46-48;
(d) SEQ ID NOs: 62-64;
(e) SEQ ID NOs: 78-80;
(f) SEQ ID NOs: 91-93;
(g) SEQ ID NOs: 106-108;
(h) SEQ ID NOs: 122-124;
(i) SEQ ID NOs: 138-140; or
(j) SEQ ID NOs: 342-344;

wherein the antibody specifically binds to human GITR.

In another embodiment, the antibody comprises heavy and light chain variable regions, wherein the light chain variable region CDR1, CDR2, and CDR3 regions comprise:

(a) SEQ ID NOs: 23-25;
(b) SEQ ID NOs: 36-38;
(c) SEQ ID NOs: 49-51;
(d) SEQ ID NOs: 65-67;
(e) SEQ ID NOs: 68-70;
(f) SEQ ID NOs: 81-83;
(f) SEQ ID NOs: 94-96;
(g) SEQ ID NOs: 109-111;
(h) SEQ ID NOs: 112-114;
(i) SEQ ID NOs: 125-127;
(j) SEQ ID NOs: 141-143;
(k) SEQ ID NOs: 144-146; or
(l) SEQ ID NOs: 345-347;

wherein the antibody specifically binds to human GITR.

In a particular embodiment, the antibody comprises heavy and light chain variable regions, wherein:

(a) the heavy chain variable region CDR1, CDR2, and CDR3 comprises SEQ ID NOs: 20-22, respectively, and the light chain variable region CDR1, CDR2, and CDR3 comprises SEQ ID NOs: 23-25, respectively;

(b) the heavy chain variable region CDR1, CDR2, and CDR3 comprises SEQ ID NOs: 33-35, respectively, and the light chain variable region CDR1, CDR2, and CDR3 comprises SEQ ID NOs: 36-38, respectively;

(c) the heavy chain variable region CDR1, CDR2, and CDR3 comprises SEQ ID NOs: 46-48, respectively, and the light chain variable region CDR1, CDR2, and CDR3 comprises SEQ ID NOs: 49-51, respectively;

(d) the heavy chain variable region CDR1, CDR2, and CDR3 comprises SEQ ID NOs: 62-64, respectively, and the light chain variable region CDR1, CDR2, and CDR3 comprises SEQ ID NOs: 65-67, respectively;

(e) the heavy chain variable region CDR1, CDR2, and CDR3 comprises SEQ ID NOs: 62-64, respectively, and the light chain variable region CDR1, CDR2, and CDR3 comprises SEQ ID NOs: 68-70, respectively;

(f) the heavy chain variable region CDR1, CDR2, and CDR3 comprises SEQ ID NOs: 78-80, respectively, and the light chain variable region CDR1, CDR2, and CDR3 comprises SEQ ID NOs: 81-83, respectively;

(g) the heavy chain variable region CDR1, CDR2, and CDR3 comprises SEQ ID NOs: 91-93, respectively, and the light chain variable region CDR1, CDR2, and CDR3 comprises SEQ ID NOs: 94-96, respectively;

(h) the heavy chain variable region CDR1, CDR2, and CDR3 comprises SEQ ID NOs: 106-108, respectively, and the light chain variable region CDR1, CDR2, and CDR3 comprises SEQ ID NOs: 109-111, respectively;

(i) the heavy chain variable region CDR1, CDR2, and CDR3 comprises SEQ ID NOs: 106-108, respectively, and the light chain variable region CDR1, CDR2, and CDR3 comprises SEQ ID NOs: 112-114, respectively;

(j) the heavy chain variable region CDR1, CDR2, and CDR3 comprises SEQ ID NOs: 122-124, respectively, and the light chain variable region CDR1, CDR2, and CDR3 comprises SEQ ID NOs: 125-127, respectively;

(k) the heavy chain variable region CDR1, CDR2, and CDR3 comprises SEQ ID NOs: 138-140, respectively, and the light chain variable region CDR1, CDR2, and CDR3 comprises SEQ ID NOs: 141-143, respectively;

(l) the heavy chain variable region CDR1, CDR2, and CDR3 comprises SEQ ID NOs: 138-140, respectively, and the light chain variable region CDR1, CDR2, and CDR3 comprises SEQ ID NOs: 144-146, respectively; or (m) the heavy chain variable region CDR1, CDR2, and CDR3 comprises SEQ ID NOs: 342-344, respectively, and the light chain variable region CDR1, CDR2, and CDR3 comprises SEQ ID NOs: 345-347, respectively;

wherein the antibody specifically binds to human GITR.

A VH domain, or one or more CDRs thereof, described herein may be linked to a constant domain for forming a heavy chain, e.g., a full length heavy chain. Similarly, a VL domain, or one or more CDRs thereof, described herein may be linked to a constant domain for forming a light chain, e.g., a full length light chain. A full length heavy chain (with the exception of the C-terminal lysine (K) or with the exception of the C-terminal glycine and lysine (GK), which may be absent) and full length light chain combine to form a full length antibody.

A VH domain described herein may be fused to the constant domain of a human IgG, e.g., IgG1, IgG2, IgG3 or IgG4, which are either naturally-occurring or modified, e.g., as further described herein. For example, a VH domain may comprise the amino acid sequence of any VH domain described herein fused to the following human IgG1 amino acid sequence:

```
                                          (SEQ ID NO: 7)
     ASTKGP SVFPLAPSSK STSGGTAALG CLVKDYFPEP

VTVSWNSGAL TSGVHTFPAV LQSSGLYSLS SVVTVPSSSL

GTQTYICNVN HKPSNTKVDK RVEPKSCDKT HTCPPCPAPE

LLGGPSVFLF PPKPKDTLMI SRTPEVTCVV VDVSHEDPEV

KFNWYVDGVE VHNAKTKPRE EQYNSTYRVV SVLTVLHQDW
```

```
LNGKEYKCKV SNKALPAPIE KTISKAKGQP REPQVYTLPP

SREEMTKNQV SLTCLVKGFY PSDIAVEWES NGQPENNYKT

TPPVLDSDGS FFLYSKLTVD KSRWQQGNVF SCSVMHEALH

NHYTQKSLSL SPG
```

The human IgG1 constant domain may also be that of an allotypic variant. For example, an allotypic variant of IgG1 comprises an R107K, E189D and M191L (underlined above) and numbering according to that in SEQ ID NO: 7). Within the full length heavy region, these amino acid substitutions are numbered R214K, E356D and M358L.

A VL domain described herein may be fused to the constant domain of a human Kappa or Lambda light chain. For example, a VL domain may comprise the amino acid sequence of any VL domain described herein fused to the following human IgG1 kappa light chain amino acid sequence:

```
                                    (SEQ ID NO: 12)
     RTV AAPSVFIFPP SDEQLKSGTA SVVCLLNNFY

PREAKVQWKV DNALQSGNSQ ESVTEQDSKD STYSLSSTLT

LSKADYEKHK VYACEVTHQG LSSPVTKSFN RGEC
```

In certain embodiments, the heavy chain constant region comprises a lysine or another amino acid at the C-terminus, e.g., it comprises the following last amino acids: LSPGK (SEQ ID NO: 220) for the heavy chain. In certain embodiments, the heavy chain constant region is lacking one or more amino acids at the C-terminus, and has, e.g., the C-terminal sequence LSPG (SEQ ID NO: 276) or LSP.

The amino acid sequences of exemplary heavy and light chains are set forth in Table 15 and correspond to SEQ ID NOs: 15, 17, 18, 28, 30, 31, 41, 43, 44, 55, 58, 59, 73, 75, 76, 86, 88, 89, 100, 102, 103, 117, 119, 120, 131, 134, 135, 227-275, 337, 339, 340, 348-352, 361, and 362 for the heavy chains and SEQ ID NOs: 16, 19, 29, 32, 42, 45, 56, 57, 60, 61, 74, 87, 90, 101, 104, 105, 118, 121, 132, 133, 136, 137, 338, 341, and 371 for the light chains.

Heavy and light chains comprising an amino acid sequence that is at least 99%, 98%, 97%, 96%, 95%, 90%, 85%, 80%, 75% or 70% identical to any of the heavy or light chains set forth in Table 15 (or their variable regions), e.g., SEQ ID NOs: 13-19, 26-32, 40-45, 52-61, 71-77, 84-90, 97-105, 116-121, 128-137, 227-275, 337-341, 348-352, 361, 362, and 371 may be used for forming anti-human GITR antibodies having the desired characteristics, e.g., those further described herein. Exemplary variants are those comprising an allotypic variation, e.g., in the constant domain, and/or a mutation in the variable or constant regions, such as the mutations disclosed herein. Heavy and light chains comprising an amino acid sequence that differs in at most 1-30, 1-25, 1-20, 1-15, 1-10, 1-5, 1-4, 1-3, 1-2 or 1 amino acid (by substitution, addition or deletion) from any of the heavy or light chains set forth in Table 15 (or their variable regions) may be used for forming anti-human GITR antibodies having the desired characteristics, e.g., those further described herein.

In various embodiments, the antibodies described above exhibit one or more, two or more, three or more, four or more, five or more, six or more, seven or more, eight or more, nine or more, ten or more, eleven, or all of the following functional properties.

(1) binding to soluble human GITR, e.g., with a $K_D$ of 10 nM or less (e.g., 0.01 nM to 10 nM), e.g., as measured by Biacore;
(2) binding to membrane bound human GITR, e.g., with a $K_D$ of 1 nM or less (e.g., 0.01 nM to 1 nM), e.g., as measured by Scatchard;
(3) binding to membrane bound human GITR, e.g., with an $EC_{50}$ of 1 nM or less (e.g., 0.01 nM to 1 nM), e.g., as measured by FACS;
(4) binding to cynomolgus GITR, e.g., bind to membrane bound cynomolgus GITR, e.g., with an $EC_{50}$ of 10 nM or less (e.g., 0.01 nM to 10 nM), e.g., as measured by FACS;
(5) inducing or enhancing T cell activation, such as in the presence of CD3 engagement (e.g., in the presence of suboptimal anti-CD3 concentrations), as evidenced, by (i) increased IL-2 and/or IFN-γ production in GITR-expressing T cells and/or (ii) enhanced T cell proliferation;
(6) inducing or enhancing T cell activation without requiring multivalent cross-linking;
(7) inhibiting the binding of GITR ligand to GITR on 3A9-hGITR cells, e.g., with an $EC_{50}$ of 1 μg/mL or less as measured by FACS;
(8) at most partially inhibiting the binding of GITR ligand to GITR on activated T cells;
(9) binding to a conformational epitope on mature human GITR (SEQ ID NO: 4), e.g., a discontinuous epitope within the amino acid sequences

```
                              (SEQ ID NO: 217)
     PTGGPGCGPGRLLLGTGT
and (SEQ ID NO: 218)
     CRDYPGEE;
```

(10) binding to both O-linked and N-linked glycosylated and unglycosylated human GITR;
(11) having agonist activity in the absence of binding to an Fc receptor, but wherein binding to an Fc receptor further enhances the agonist activity; and
(12) competing in either direction or both directions for binding to human GITR with 28F3, 3C3-1, 3C3-2, 2G6, 8A6, 9G7-1, 9G7-2, 14E3, 19H8-1, 19H8-2, 19D3, 18E10, and/or 6G10.

Such antibodies include, for example, human antibodies, humanized antibodies, or chimeric antibodies.

In one embodiment, the anti-GITR antibodies described herein bind to both glycosylated (e.g., N-linked or O-linked glycosylation) and unglycosylated human GITR.

In one embodiment, the anti-GITR antibodies described herein bind to a conformational epitope.

In one embodiment, the anti-GITR antibodies described herein bind to amino acid residues within the following region of mature human GITR (SEQ ID NO: 4):

```
                                    (SEQ ID NO: 215)
     QRPTGGPGCGPGRLLLGTGTDARCCRVHTTRCCRDYPGE,
``` corresponding to amino acid residues 1-39 of mature human GITR isoforms 1, 2 or 3 (SEQ ID NO: 4).

In one embodiment, the anti-GITR antibody described herein binds to amino acid residues within the following region of mature human GITR (SEQ ID NO: 4):

QRPTGGPGCGPGRLLLGTGT, (SEQ ID NO: 216)

corresponding to amino acid residues 1-20 of mature human GITR isoforms 1, 2 or 3 (SEQ ID NO: 4).

In one embodiment, the anti-GITR antibody described herein binds to amino acid residues within the following regions of mature human GITR (SEQ ID NO: 4):

PTGGPGCGPGRLLLGTGT (SEQ ID NO: 217)
and

CRDYPGEE. (SEQ ID NO: 218)

Modified Heavy Chain Constant Domains

As further discussed herein, the heavy chain constant region of anti-GITR antibodies described herein may be of any isotype, e.g., IgG1, IgG2, IgG3 and IgG4, or combinations thereof and/or modifications thereof. An anti-GITR antibody may have effector function or may have reduced or no effector function. In certain embodiments, anti-GITR antibodies comprise a modified heavy chain constant region that provides enhanced properties to the antibody. As shown in the Examples, anti-GITR antibodies, having a modified heavy chain constant region comprising an IgG2 hinge are more potent agonists relative to antibodies having the same variable region but with a non-IgG2 hinge. For example, an antibody comprising an IgG2 hinge, a CH2 and CH3 domain of the IgG1 isotype, and whether with or without effector function, has enhanced agonist activity as measured by enhanced secretion of IFN-γ and IL-2 from T cells incubated with the antibodies. Without wanting to be limited to a specific mechanism of action, it is hypothesized that anti-GITR antibodies having IgG2 hinges form larger antibody/antigen complexes and are more effectively internalized, thereby resulting in increased agonist activity. The formation of large complexes is believed to result from a higher stiffness of the IgG2 hinge relative to hinges of other isotypes (e.g., IgG1, IgG3 and IgG4). As further described in the Examples, an enhanced agonist activity does not appear to be associated with a higher or lower affinity of the antibody. Accordingly, provided herein are anti-GITR antibodies having a modified heavy chain constant region, wherein the anti-GITR antibodies have an enhanced agonist activity, and wherein, the affinity of the antibody with the modified heavy chain constant region binds to GITR with a similar affinity as the same variable regions, but with a different heavy chain constant region.

Accordingly, provided herein are also methods for enhancing the agonist activity of anti-GITR antibodies, comprising providing an anti-GITR antibody that has a non-IgG2 hinge, and replacing the non-IgG2 hinge with an IgG2 hinge. Antibodies that may benefit from such a modification includes any anti-GITR antibody, such as those known in the art, e.g., antibody 6C8 or a humanized antibody having the CDRs of 6C8, as described, e.g., in WO2006/105021; an antibody described in WO2011/028683, JP2008278814, KR20080105674, US20040072566, US2001472565, US20140065152 or in WO2015/031667.

In certain embodiments, a modified heavy chain constant region comprises a hinge of the IgG2 isotype (an "IgG2 hinge") and a CH1, CH2 and CH3 domain. In certain embodiments, a modified heavy chain constant region comprises an IgG2 hinge and a CH1, CH2 and CH3 domain, wherein at least one of the CH1, CH2 and CH3 domains is not of the IgG2 isotype. The IgG2 hinge may be a wildtype IgG2 hinge, e.g., a wildtype human IgG2 hinge (e.g., ERKCCVECPPCPAPPVAG; SEQ ID NO: 291) or a variant thereof, provided that the IgG2 hinge retains the ability to confer to the antibody an enhanced activity relative to the same antibody that comprises a non-IgG2 hinge. In certain embodiments, an IgG2 hinge variant retains similar rigidity or stiffness to that of a wildtype IgG2 hinge. The rigidity of a hinge can be determined, e.g., by computer modeling, electron microscopy, spectroscopy such as Nuclear Magnetic Resonance (NMR), X-ray crystallography (B-factors), or Sedimentation Velocity Analytical ultracentrifugation (AUC) to measure or compare the radius of gyration of antibodies comprising the hinge. A hinge may have similar or higher rigidity relative to another hinge if an antibody comprising the hinge has a value obtained from one of the tests described in the previous sentence that differs from the value of the same antibody with a different hinge, e.g., an IgG1 hinge, in less than 5%, 10%, 25%, 50%, 75%, or 100%. A person of skill in the art would be able to determine from the tests whether a hinge has at least similar rigidity to that of another hinge by interpreting the results of these tests. An exemplary human IgG2 hinge variant is an IgG2 hinge that comprises a substitution of one or more of the four cysteine residues (i.e., C219, C220, C226 and C229) with another amino acid. A cysteine may be replaced by a serine. An exemplary IgG2 hinge is a human IgG2 hinge comprising a C219X mutation or a C220X mutation, wherein X is any amino acid except serine. In a certain embodiments, an IgG2 hinge does not comprise both a C219X and a C220X substitution. In certain embodiments, an IgG2 hinge comprises C219S or C220S, but not both C219S and C220S (e.g., ERKSCVECPPCPAPPVAG; SEQ ID NO: 292). Other IgG2 hinge variants that may be used include human IgG2 hinges comprising a C220, C226 and/or C229 substitution, e.g., a C220S, C226S or C229S mutation (which may be combined with a C219S mutation). An IgG2 hinge may also be an IgG2 hinge in which a portion of the hinge is that of another isotype (i.e., it is a chimeric or hybrid hinge), provided that the rigidity of the chimeric hinge is at least similar to that of a wildtype IgG2 hinge. For example, an IgG2 hinge may be an IgG2 hinge in which the lower hinge (as defined in Table 2) is of an IgG1 isotype, and is, e.g., a wildtype IgG1 lower hinge. Additional IgG2 hinge mutations that may be used in an IgG2 hinge include the SE (S267E), SELF (S267E/L328F), SDIE (S239D/I332E), SEFF and GASDALIE (G236A/S239D/A330L/I332E) mutations.

A "hybrid" or "chimeric" hinge is referred to as being of a specific isotype if more than half of the consecutive amino acids of the hinge are from that isotype. For example, a hinge having an upper and middle hinge of IgG2 and the lower hinge of IgG1 is considered to be an IgG2 hybrid hinge.

In certain embodiments, an anti-GITR antibody comprises a modified heavy chain constant region that comprises an IgG2 hinge comprising one of the following sequences:

ERKCCVECPPCPAPPVAG; (SEQ ID NO: 447)

ERKSCVECPPCPAPPVAG; (SEQ ID NO: 448)

ERKCSVECPPCPAPPVAG; (SEQ ID NO: 449)

ERKXCVECPPCPAPPVAG; (SEQ ID NO: 450)

```
ERKCXVECPPCPAPPVAG;                    (SEQ ID NO: 451)

ERKCCVECPPCPAPPVAGX;                   (SEQ ID NO: 452)

ERKSCVECPPCPAPPVAGX;                   (SEQ ID NO: 453)

ERKCSVECPPCPAPPVAGX;                   (SEQ ID NO: 454)

ERKXCVECPPCPAPPVAGX;                   (SEQ ID NO: 455)

ERKCXVECPPCPAPPVAGX;                   (SEQ ID NO: 456)

ERKCCVECPPCPAPELLGG;                   (SEQ ID NO: 457)

ERKSCVECPPCPAPELLGG;                   (SEQ ID NO: 458)

ERKCCSVECPPCPAPELLGG;                  (SEQ ID NO: 459)

ERKXCVECPPCPAPELLGG;                   (SEQ ID NO: 460)

ERKCXVECPPCPAPELLGG;                   (SEQ ID NO: 461)

ERKCCVECPPCPAPELLG;                    (SEQ ID NO: 462)

ERKSCVECPPCPAPELLG;                    (SEQ ID NO: 463)

ERKCCSVECPPCPAPELLG;                   (SEQ ID NO: 464)

ERKXCVECPPCPAPELLG;                    (SEQ ID NO: 465)

ERKCXVECPPCPAPELLG;                    (SEQ ID NO: 466)

ERKCCVECPPCPAP;                        (SEQ ID NO: 467)

ERKSCVECPPCPAP;                        (SEQ ID NO: 468)

ERKCSVECPPCPAP;                        (SEQ ID NO: 469)

ERKXCVECPPCPAP;                        (SEQ ID NO: 470)
or

ERKCXVECPPCPAP,                        (SEQ ID NO: 471)
``` wherein X is any amino acid, except a cysteine, or any of the above sequences, in which 1-5, 1-3, 1-2 or 1 amino acid is inserted between amino acid residues CVE and CPP. In certain embodiments, THT or GGG is inserted. In certain embodiments, 1, 1-2, or 1-3 amino acids are inserted between the hinge and CH2 domain. For example, a glycine may be inserted between the hinge and CH2 domain.

In certain embodiments, the hinge comprises SEQ ID NO: 447, 448, 449, 450, or 451, wherein 1, 2, 3 or all 4 amino acids P233, V234, A235 and G237 (corresponding to the C-terminal 4 amino acids "PVAG" (SEQ ID NO: 472) are deleted or substituted with another amino acid, e.g., the amino acids of the C-terminus of the IgG1 hinge (ELLG (SEQ ID NO: 473) or ELLGG (SEQ ID NO: 474). In certain embodiments, the hinge comprises SEQ ID NO: 447, 448, 449, 450, or 451, wherein V234, A235 and G237 are deleted or substituted with another amino acid. In certain embodiments, the hinge comprises SEQ ID NO: 447, 448, 449, 450, or 451, wherein A235 and G237 are deleted or substituted with another amino acid. In certain embodiments, the hinge comprises SEQ ID NO: 447, 448, 449, 450, or 451, wherein G237 is deleted or substituted with another amino acid. In certain embodiments, the hinge comprises SEQ ID NO: 447, 448, 449, 450, or 451, wherein V234 and A235 are deleted or substituted with another amino acid. Substitution of PVAG (SEQ ID NO: 472) in an IgG2 with the corresponding amino acids of an IgG1 hinge, i.e., (ELLG (SEQ ID NO: 473) or ELLGG (SEQ ID NO: 474)) to obtain a hybrid hinge, e.g., shown above, that provides a hinge having the advantages of an IgG2 hinge and the effector function of IgG1 hinges.

In certain embodiments, a modified heavy chain constant region comprises a hinge that consists of or consists essentially of one of the sequences shown above, e.g., any one of SEQ ID NOs: 447-471, and in certain embodiments, does not comprise additional hinge amino acid residues.

In certain embodiments an anti-CD73 antibody comprises a modified heavy chain constant region comprising an IgG1 or IgG2 constant region, wherein the hinge comprises a deletion of 1-10 amino acids. As shown in the Examples, an IgG1 antibody lacking amino acid residues SCDKTHT (S219, C220, D221, K222, T223, H224 and T225; SEQ ID NO: 475) conferred antibody mediated CD73 internalization more effectively than the same antibody having a wildtype IgG1 constant region. Similarly, in the context of an IgG2 antibody, an IgG2 antibody lacking amino acid residues CCVE (C219, C220, V222, and E224; SEQ ID NO: 476) conferred antibody mediated CD73 internalization more effectively than the same antibody having a wildtype IgG1 constant region. Accordingly, provided herein are modified heavy chain constant region in which the hinge comprises a deletion of 1, 2, 3, 4, 5, 6, or 7 amino acid residues, selected from residues S219, C220, D221, K222, T223, H224 and T225 for an IgG1 antibody, and residues C219, C220, V222, and E224 for an IgG2 antibody.

In certain embodiments, a modified heavy chain constant region comprises a CH1 domain that is a wildtype CH1 domain of the IgG1 or IgG2 isotype ("IgG1 CH1 domain" or "IgG2 CH1 domain," respectively). CH1 domains of the isotypes IgG3 and IgG4 ("IgG3 CH1 domain and "IgG2 CH1 domain," respectively) may also be used. A CH1 domain may also be a variant of a wildtype CH1 domain, e.g., a variant of a wildtype IgG1, IgG2, IgG3 or IgG4 CH1 domain. Exemplary variants of CH1 domains include A114C and T173C and/or C131, e.g., C131S.

A CH1 domain, e.g., an IgG2 CH1 domain, may comprise the substitution C131S, which substitution confers onto an IgG2 antibody or antibody having an IgG2 CH1 and hinge the B form (or conformation).

In certain embodiments, a modified heavy chain constant region comprises a CH1 domain that is of the IgG2 isotype. In certain embodiments, the CH1 domain is wildtype IgG2 CH1 domain, e.g., having the amino acid sequence: ASTKGPSVFPLAPCSRSTSES TAALGCLVKDYF-PEPVTVSWNSGALTSGVHTFPAVLQSS GLYS-LSSVVTVPSSNFGTQTYTCNVDHKPSNTKVDKTV (SEQ ID NO: 477). In certain embodiments, the CH1 domain is a variant of SEQ ID NO: 477 and comprises 1-10, 1-5, 1-2 or 1 amino acid substitutions or deletions relative to SEQ ID NO: 477. As further described in the Examples, it has been shown herein that an IgG2 CH1 domain or variants thereof confer enhanced or altered internalization properties to anti-GITR antibodies relative to IgG1 antibodies and even more enhanced or altered internalization when the antibodies also comprise an IgG2 hinge. In certain embodiments, IgG2 CH1 variants do not comprise an amino acid substitution or deletion at one or more of the following amino acid residues: C131, R133, E137 and S138, which amino acid residues are shown in bold and underlined in SEQ ID NO: 477 shown above. For example, a modified heavy chain constant region may comprise an IgG2 CH1 domain in which neither of R133, E137 and S138 are substituted with another amino acid or are detailed or in which neither of C131, R133, E137 and S138 are substituted with another amino acid or are detailed. In certain embodiments, C131 is substituted with another amino acid, e.g., C131S, which substitution triggers the antibody to adopt conformation B. Both conformation A and conformation B antibodies having modified heavy chain constant regions have been shown herein to have enhanced activities relative to the same antibody with an IgG1 constant region.

In certain embodiments, N192 and/or F193 (shown as italicized and underlined residues in SEQ ID NO: 477 shown above) are substituted with another amino acid, e.g., with the corresponding amino acids in IgG1, i.e., N192S and/or F193L.

In certain embodiments, one or more amino acid residues of an IgG2 CH1 domain are substituted with the corresponding amino acid residues in IgG4. For example, N192 may be N192S; F193 may be F193L; C131 may be C131K; and/or T214 may be T214R.

An antibody may comprise a modified heavy chain constant region comprising an IgG2 CH1 domain or variant thereof and IgG2 hinge or variant thereof. The hinge and CH1 domain may be a combination of any IgG2 hinge and IgG2 CH1 domain described herein. In certain embodiments, the IgG2 CH1 and hinge comprise the following amino acid sequence (SEQ ID NO: 478)
ASTKGPSVFPLAPCSRSTSESTAALGCLVKDYFPEPVTVSWNSGALTSG
VHTFPAVLQSSGLYSLSSVVTVPSS*NF*GTQTYTCNVDHKPSNTKVDKTV
ERKCCVECPPCPAPPVAG, or an amino acid sequence that differs therefrom in at most 1-10 amino acids. The amino acid variants are as described for the hinge and CH1 domains above. In certain embodiments, antibodies comprise at least an IgG2 hinge, and optionally also an IgG2 CH1 domain or fragment or derivative of the hinge and/or CH1 domain and the antibody has adopted form (of conformation) A (see, e.g., Allen et al. (2009) Biochemistry 48:3755). In certain embodiments, anti-CD73 antibodies comprise at least an IgG2 hinge, and optionally also an IgG2 CH1 domain or fragment or derivative of the hinge and/or CH1 domain and the antibody has adopted form B (see, e.g., Allen et al. (2009) Biochemistry 48:3755).

In certain embodiments, a modified heavy chain constant region comprises a CH2 domain that is a wildtype CH2 domain of the IgG1, IgG2, IgG3 or IgG4 isotype ("IgG1 CH2 domain," "IgG2 CH2 domain," "IgG3 CH2 domain," or "IgG4 CH2 domain," respectively). A CH2 domain may also be a variant of a wildtype CH2 domain, e.g., a variant of a wildtype IgG1, IgG2, IgG3 or IgG4 CH2 domain. Exemplary variants of CH2 domains include variants that modulate a biological activity of the Fc region of an antibody, such as ADCC or CDC or modulate the half-life of the antibody or its stability. In one embodiment, the CH2 domain is a human IgG1 CH2 domain with an A330S and P331S mutation, wherein the CH2 domain has reduced effector function relative to the same CH2 mutation without the mutations. A CH2 domain may have enhanced effector function. CH2 domains may comprise one or more of the following mutations: SE (S267E), SELF (S267E/L328F), SDIE (S239D/I332E), SEFF and GASDALIE (G236A/S239D/A330L/I332E) and/or one or more mutations at the following amino acids: E233, G237, P238, H268, P271L328 and A330. Other mutations are further set forth herein elsewhere.

In certain embodiments, a modified heavy chain constant region comprises a CH3 domain that is a wildtype CH3 domain of the IgG1, IgG2, IgG3 or IgG4 isotype ("IgG1 CH3 domain," "IgG2 CH3 domain," "IgG3 CH3 domain," or "IgG4 CH3 domain," respectively). A CH3 domain may also be a variant of a wildtype CH3 domain, e.g., a variant of a wildtype IgG1, IgG2, IgG3 or IgG4 CH3 domain. Exemplary variants of CH3 domains include variants that modulate a biological activity of the Fc region of an antibody, such as ADCC or CDC or modulate the half-life of the antibody or its stability.

Generally, variants of the CH1, hinge, CH2 or CH3 domains may comprise 1, 2, 3, 4, 5, 6, 7, 8, 9, 10 or more mutations, and/or at most 10, 9, 8, 7, 6, 5, 4, 3, 2 or 1 mutation, or 1-10 or 1-5 mutations, or comprise an amino acid sequence that is at least about 75%, 80%, 85%, 90%, 95%, 96%, 97%, 98%, or 99% identical to that of the corresponding wildtype domain (CH1, hinge, CH2, or CH3 domain, respectively), provided that the heavy chain constant region comprising the specific variant retains the necessary biological activity.

Table 3 sets forth exemplary human heavy chain constant regions comprising a human CH1, hinge, CH2 and/or CH3 domains, wherein each domain is either a wildtype domain or a variant thereof that provides the desired biological activity to the heavy chain constant region. An unfilled cell in Table 3 indicates that the domain is present or not, and if present can be of any isotype, e.g., IgG1, IgG2, IgG3 or IgG4. For example, an antibody comprising the heavy chain constant region 1 in Table 3 is an antibody that comprises a heavy chain constant region comprising at least an IgG2 hinge, and which may also comprise a CH1, CH2 and/or CH3 domain, and if present, which CH1, CH2 and/or CH3 domain is of an IgG1, IgG2, IgG3 or IgG4 isotype. As another example for understanding Table 3, an antibody comprising a heavy chain constant region 8 is an antibody comprising a heavy chain constant region comprising an IgG1 CH1 domain, and IgG2 hinge, an IgG1 CH2 domain, and which may or may not also comprise a CH3 domain, which if present, may be of an IgG1, IgG2, IgG3 or IgG4 isotype.

TABLE 3

Exemplary configurations of human heavy chain constant regions

| MHCCR* | CH1 | Hinge | CH2 | CH3 |
|---|---|---|---|---|
| 1 |  | IgG2 |  |  |
| 2 | IgG1 | IgG2 |  |  |
| 3 | IgG2 | IgG2 |  |  |

TABLE 3-continued

Exemplary configurations of human heavy chain constant regions

| MHCCR* | CH1 | Hinge | CH2 | CH3 |
|---|---|---|---|---|
| 4 |  | IgG2 | IgG1 |  |
| 5 |  | IgG2 | IgG2 |  |
| 6 |  | IgG2 |  | IgG1 |
| 7 |  | IgG2 |  | IgG2 |
| 8 | IgG1 | IgG2 | IgG1 |  |
| 9 | IgG1 | IgG2 | IgG2 |  |
| 10 | IgG2 | IgG2 | IgG1 |  |
| 11 | IgG2 | IgG2 | IgG2 |  |
| 12 | IgG1 | IgG2 |  | IgG1 |
| 13 | IgG1 | IgG2 |  | IgG2 |
| 14 | IgG2 | IgG2 |  | IgG1 |
| 15 | IgG2 | IgG2 |  | IgG2 |
| 16 |  | IgG2 | IgG1 | IgG1 |
| 17 |  | IgG2 | IgG1 | IgG2 |
| 18 |  | IgG2 | IgG2 | IgG1 |
| 19 |  | IgG2 | IgG2 | IgG2 |
| 20 | IgG1 | IgG2 | IgG1 | IgG1 |
| 21 | IgG1 | IgG2 | IgG1 | IgG2 |
| 22 | IgG1 | IgG2 | IgG2 | IgG1 |
| 23 | IgG1 | IgG2 | IgG2 | IgG2 |
| 24 | IgG2 | IgG2 | IgG1 | IgG1 |
| 25 | IgG2 | IgG2 | IgG1 | IgG2 |
| 26 | IgG2 | IgG2 | IgG2 | IgG1 |
| 27 | IgG2 | IgG2 | IgG2 | IgG2 |

*Modified heavy chain constant region

In certain embodiments, an antibody comprising a heavy chain constant region shown in Table 3 has an enhanced biological activity relative to the same antibody comprising a heavy chain constant region that does not comprise that specific heavy chain constant region or relative to the same antibody that comprises an IgG1 constant region.

In certain embodiments, a method for improving the biological activity of a GITR antibody that comprises a non-IgG2 hinge and/or non-IgG2 CH1 domain comprises providing an anti-GITR antibody that comprises a non-IgG2 hinge and/or a non-IgG2 CH1 domain, and replacing the non-IgG2 hinge and the non-IgG2 CH1 domain with an IgG2 hinge and an IgG2 CH1 domain, respectively. A method for improving the biological activity of a GITR antibody that does not comprise a modified heavy chain constant region, may comprise providing an anti-GITR antibody that does not comprise a modified heavy chain constant region, and replacing its heavy chain constant region with a modified heavy chain constant region.

Exemplary modified heavy chain constant regions that may be linked to anti-GITR variable regions, e.g., those described herein, are provided in Table 4, which sets forth the identity of each of the domains.

TABLE 4

Exemplary modified heavy chain constant regions

| Modified heavy chain constant region | CH1 | Hinge | CH2 | CH3 | SEQ ID NO of whole MHCCR |
|---|---|---|---|---|---|
| IgG1-IgG2-IgG1f | IgG1 wildtype SEQ ID NO: 278 | IgG2/IgG1 SEQ ID NO: 293 | IgG1 wildtype SEQ ID NO: 280 | IgG1 wildtype SEQ ID NO: 282 | SEQ ID NO: 283 |
| IgG1-IgG2-IgG1f2 | IgG1 wildtype SEQ ID NO: 278 | IgG2 wildtype SEQ ID NO: 291 | IgG1 wildtype SEQ ID NO: 280 | IgG1 wildtype SEQ ID NO: 282 | SEQ ID NO: 287 |
| IgG1-IgG2CS-IgG1f | IgG1 wildtype SEQ ID NO: 278 | IgG2C219S/IgG1 SEQ ID NO: 294 | IgG1 wildtype SEQ ID NO: 280 | IgG1 wildtype SEQ ID NO: 282 | SEQ ID NO: 284 |
| IgG1-IgG2CS-IgG1f2 | IgG1 wildtype SEQ ID NO: 278 | IgG2 C219S SEQ ID NO: 292 | IgG1 wildtype SEQ ID NO: 280 | IgG1 wildtype SEQ ID NO: 282 | SEQ ID NO: 288 |
| IgG2-IgG1f | IgG2 wildtype SEQ ID NO: 279 | IgG2/IgG1 SEQ ID NO: 293 | IgG1 wildtype SEQ ID NO: 280 | IgG1 wildtype SEQ ID NO: 282 | SEQ ID NO: 223 |
| IgG2-IgG1f2 | IgG2 wildtype SEQ ID NO: 279 | IgG2 wildtype SEQ ID NO: 291 | IgG1 wildtype SEQ ID NO: 280 | IgG1 wildtype SEQ ID NO: 282 | SEQ ID NO: 289 |
| IgG2CS-IgG1f | IgG2 wildtype SEQ ID NO: 279 | IgG2C219S/IgG1 SEQ ID NO: 294 | IgG1 wildtype SEQ ID NO: 280 | IgG1 wildtype SEQ ID NO: 282 | SEQ ID NO: 225 |
| IgG2CS-IgG1f2 | IgG2 wildtype SEQ ID NO: 279 | IgG2 C219S SEQ ID NO: 292 | IgG1 wildtype SEQ ID NO: 280 | IgG1 wildtype SEQ ID NO: 282 | SEQ ID NO: 290 |
| IgG1-IgG2-IgG1.1f | IgG1 wildtype SEQ ID NO: 278 | IgG2 wildtype SEQ ID NO: 291 | IgG1 A330S/P331S SEQ ID NO: 281 | IgG1 wildtype SEQ ID NO: 282 | SEQ ID NO: 285 |
| IgG1-IgG2CS-IgG1.1f | IgG1 wildtype SEQ ID NO: 278 | IgG2 C219S SEQ ID NO: 292 | IgG1 A330S/P331S SEQ ID NO: 281 | IgG1 wildtype SEQ ID NO: 282 | SEQ ID NO: 286 |
| IgG2-IgG1.1f | IgG2 wildtype SEQ ID NO: 279 | IgG2 wildtype SEQ ID NO: 291 | IgG1 A330S/P331S SEQ ID NO: 281 | IgG1 wildtype SEQ ID NO: 282 | SEQ ID NO: 224 |
| IgG2CS-IgG1.1f | IgG2 wildtype SEQ ID NO: 279 | IgG2 C219S SEQ ID NO: 292 | IgG1 A330S/P331S SEQ ID NO: 281 | IgG1 wildtype SEQ ID NO: 282 | SEQ ID NO: 226 |

In certain embodiments, an anti-GITR antibody comprises a modified heavy chain constant region comprising an IgG2 hinge comprising any one of SEQ ID NO: 291, 292, 293, 294, and 447-471 or a variant thereof, such as an IgG2 hinge comprising an amino acid sequence that (i) differs from any one of SEQ ID NO: 291, 292, 293, 294, and 447-471 in 1, 2, 3, 4 or 5 amino acids substitutions, additions or deletions; (ii) differs from any one of SEQ ID NO: 291, 292, 293, 294, or 447-471 in at most 5, 4, 3, 2, or 1 amino acids substitutions, additions or deletions; (iii) differs from any one of SEQ ID NO: 291, 292, 293, 294, or 447-471 in 1-5, 1-3, 1-2, 2-5 or 3-5 amino acids substitutions, additions or deletions and/or (iv) comprises an amino acid sequence that is at least about 75%, 80%, 85%, 90%, 95%, 96%, 97%, 98% or 99% identical to any one of SEQ ID NO: 291, 292, 293, 294, or 447-471, wherein in any of (i)-(iv), an amino acid substitution may be a conservative amino acid substitution or a non-conservative amino acid substitution; and wherein the modified heavy chain constant region provides an enhanced agonist activity to an anti-GITR antibody relative to another heavy chain constant region, e.g., a heavy chain constant region that comprises a non-IgG2 hinge or relative to the same modified heavy chain constant region that comprises a non-IgG2 hinge.

In certain embodiments, an anti-GITR antibody comprises a modified heavy chain constant region comprising an IgG1 CH1 domain comprising SEQ ID NO: 278 or an IgG2 CH1 domain comprising SEQ ID NO: 279, or a variant of SEQ ID NO: 278 or 279, which variant (i) differs from SEQ ID NO: 278 or 279 in 1, 2, 3, 4 or 5 amino acids substitutions, additions or deletions; (ii) differs from SEQ ID NO: 278 or 279 in at most 5, 4, 3, 2, or 1 amino acids substitutions, additions or deletions; (iii) differs from SEQ ID NO: 278 or 279 in 1-5, 1-3, 1-2, 2-5 or 3-5 amino acids substitutions, additions or deletions and/or (iv) comprises an amino acid sequence that is at least about 75%, 80%, 85%, 90%, 95%, 96%, 97%, 98% or 99% identical to SEQ ID NO: 278 or 279, wherein in any of (i)-(iv), an amino acid substitution may be a conservative amino acid substitution or a non-conservative amino acid substitution; and wherein the anti-GITR antibody comprising a modified heavy chain constant region has an enhanced agonist activity relative to that of the anti-GITR antibody but with another heavy chain constant region, e.g., a heavy chain constant region that comprises a non-IgG2 hinge or relative to the same modified heavy chain constant region that comprises a non-IgG2 hinge.

In certain embodiments, an anti-GITR antibody comprises a modified heavy chain constant region comprising an IgG1 CH2 domain comprising SEQ ID NO: 280 or 281, or a variant of SEQ ID NO: 280 or 281, which variant (i) differs from SEQ ID NO: 280 or 281 in 1, 2, 3, 4 or 5 amino acids substitutions, additions or deletions; (ii) differs from SEQ ID NO: 280 or 281 in at most 5, 4, 3, 2, or 1 amino acids substitutions, additions or deletions; (iii) differs from SEQ ID NO: 280 or 281 in 1-5, 1-3, 1-2, 2-5 or 3-5 amino acids substitutions, additions or deletions and/or (iv) comprises an amino acid sequence that is at least about 75%, 80%, 85%, 90%, 95%, 96%, 97%, 98% or 99% identical to SEQ ID NO: 280 or 281, wherein in any of (i)-(iv), an amino acid substitution may be a conservative amino acid substitution or a non-conservative amino acid substitution; and wherein the modified heavy chain constant region provides an enhanced agonist activity to an anti-GITR antibody relative to that of another heavy chain constant region, e.g., a heavy chain constant region that comprises a non-IgG2 hinge or relative to the same modified heavy chain constant region that comprises a non-IgG2 hinge.

In certain embodiments, an anti-GITR antibody comprises a modified heavy chain constant region comprising an IgG1 CH3 domain comprising SEQ ID NO: 282, or a variant of SEQ ID NO: 282, which variant (i) differs from SEQ ID NO: 282 in 1, 2, 3, 4 or 5 amino acids substitutions, additions or deletions; (ii) differs from SEQ ID NO: 282 in at most 5, 4, 3, 2, or 1 amino acids substitutions, additions or deletions; (iii) differs from SEQ ID NO: 282 in 1-5, 1-3, 1-2, 2-5 or 3-5 amino acids substitutions, additions or deletions and/or (iv) comprises an amino acid sequence that is at least about 75%, 80%, 85%, 90%, 95%, 96%, 97%, 98% or 99% identical to SEQ ID NO: 282, wherein in any of (i)-(iv), an amino acid substitution may be a conservative amino acid substitution or a non-conservative amino acid substitution; and wherein the modified heavy chain constant region provides an enhanced agonist activity relative to that of another heavy chain constant region, e.g., a heavy chain constant region that comprises a non-IgG2 hinge or relative to the same modified heavy chain constant region that comprises a non-IgG2 hinge.

Modified heavy chain constant regions may also comprise a combination of the CH1, hinge, CH2 and CH3 domains described above.

In certain embodiments, an anti-GITR antibody comprises a modified heavy chain constant region comprising any one of SEQ ID NOs: 223, 224, 225, 226, 283, 284, 285 286, 287, 288, 289, 290, 383-446 and 480-543 or a variant of any one of SEQ ID NOs: 223, 224, 225, 226, 283, 284, 285 286, 287, 288, 289, 290, 383-446 and 480-543, which variant (i) differs from any one of SEQ ID NOs: 223, 224, 225, 226, 283, 284, 285 286, 287, 288, 289, 290, 383-446 and 480-543 in 1, 2, 3, 4, 5, 6, 7, 8, 9, 10 or more amino acids substitutions, additions or deletions; (ii) differs from any one of SEQ ID NOs: 223, 224, 225, 226, 283, 284, 285 286, 287, 288, 289, 290, 383-446 and 480-543 in at most 10, 9, 8, 7, 6, 5, 4, 3, 2, or 1 amino acids substitutions, additions or deletions; (iii) differs from any one of SEQ ID NOs: 223, 224, 225, 226, 283, 284, 285 286, 287, 288, 289, 290, 383-446 and 480-543 in 1-5, 1-3, 1-2, 2-5, 3-5, 1-10, or 5-10 amino acids substitutions, additions or deletions and/or (iv) comprises an amino acid sequence that is at least about 75%, 80%, 85%, 90%, 95%, 96%, 97%, 98% or 99% identical to a sequence selected from SEQ ID NOs: 223, 224, 225, 226, 283, 284, 285 286, 287, 288, 289, 290, 383-446 and 480-543, wherein in any of (i)-(iv), an amino acid substitution may be a conservative amino acid substitution or a non-conservative amino acid substitution and the modification(s) does not occur at the amino acid in SEQ ID NO: 223, 224, 225, 226, 283, 284, 285 286, 287, 288, 289, 290, 383-446 and 480-543 that differs from the wild type amino acid at that position; and wherein the modified heavy chain constant region provides an enhanced agonist activity relative to that of another heavy chain constant region, e.g., a heavy chain constant region that comprises a non-IgG2 hinge or relative to the same modified heavy chain constant region that comprises a non-IgG2 hinge.

Modified heavy chain constant regions may have (i) similar, reduced or increased effector function (e.g., binding to an FcγR) relative to a wildtype heavy chain constant region and or (ii) similar, reduced or increased half-life (or binding to the FcRn receptor) relative to a wildtype heavy chain constant region.

III. Antibodies Having Particular Germline Sequences

In certain embodiments, an anti-GITR antibody comprises a heavy chain variable region from a particular germline heavy chain immunoglobulin gene and/or a light chain variable region from a particular germline light chain immunoglobulin gene.

As demonstrated herein, human antibodies specific for GITR have been prepared that comprise a heavy chain variable region that is the product of or derived from a human germline VH 3-33 gene, VH 3-10 gene, VH 3-15 gene, VH 3-16, VH JH6b gene, VH 6-19 gene, VH 4-34 gene, and/or VH JH3b gene. Accordingly, provided herein are isolated monoclonal antibodies, or antigen-binding portions thereof, comprising a heavy chain variable region that is the product of or derived from a human VH germline gene selected from the group consisting of: VH 3-33, VH 3-10, VH 3-15, VH 3-16, VH JH6b, VH 6-19, VH 4-34, and/or VH JH3b.

Human antibodies specific for GITR have been prepared that comprise a light chain variable region that is the product of or derived from a human germline VK L6 gene, VK L18 gene, VK L15 gene, VK L20 gene, VK A27 gene, VK JK5 gene, VK JK4 gene, VK JK2 gene, and VK JK1 gene. Accordingly, provide herein are isolated monoclonal antibodies, or antigen-binding portions thereof, comprising a light chain variable region that is the product of or derived from a human VK germline gene selected from the group consisting of: VK L6, VK L18, VK L15, VK L20, VK A27, VK JK5, VK JK4, VK JK2, and VK JK1.

Preferred antibodies described herein are those comprising a heavy chain variable region that is the product of or derived from one of the above-listed human germline VH genes and also comprising a light chain variable region that is the product of or derived from one of the above-listed human germline VK genes, as shown in FIGS. 2-11.

As used herein, a human antibody comprises heavy or light chain variable regions that is "the product of" or "derived from" a particular germline sequence if the variable regions of the antibody are obtained from a system that uses human germline immunoglobulin genes. Such systems include immunizing a transgenic mouse carrying human immunoglobulin genes with the antigen of interest or screening a human immunoglobulin gene library displayed on phage with the antigen of interest. A human antibody that is "the product of" or "derived from" a human germline immunoglobulin sequence can be identified as such by comparing the amino acid sequence of the human antibody to the amino acid sequences of human germline immunoglobulins and selecting the human germline immunoglobulin sequence that is closest in sequence (i.e., greatest % identity) to the sequence of the human antibody. A human antibody that is "the product of" or "derived from" a particular human germline immunoglobulin sequence may contain amino acid differences as compared to the germline sequence, due to, for example, naturally-occurring somatic mutations or intentional introduction of site-directed mutation. However, a selected human antibody typically is at least 90% identical in amino acids sequence to an amino acid sequence encoded by a human germline immunoglobulin gene and contains amino acid residues that identify the human antibody as being human when compared to the germline immunoglobulin amino acid sequences of other species (e.g., murine germline sequences). In certain cases, a human antibody may be at least 95%, or even at least 96%, 97%, 98%, or 99% identical in amino acid sequence to the amino acid sequence encoded by the germline immunoglobulin gene. Typically, a human antibody derived from a particular human germline sequence will display no more than 10 amino acid differences from the amino acid sequence encoded by the human germline immunoglobulin gene. In certain cases, the human antibody may display no more than 5, or even no more than 4, 3, 2, or 1 amino acid difference from the amino acid sequence encoded by the germline immunoglobulin gene.

IV. Homologous Antibodies

Encompassed herein are antibodies having heavy and light chain variable regions comprising amino acid sequences that are homologous to the amino acid sequences of the preferred antibodies described herein, and wherein the antibodies retain the desired functional properties of the anti-GITR antibodies described herein.

For example, an isolated anti-GITR antibody, or antigen binding portion thereof, may comprise a heavy chain variable region and a light chain variable region, wherein:

(a) the heavy chain variable region comprises an amino acid sequence that is at least 80%, 85%, 90%, 95%, 96%, 97%, 98% or 99% identical to an amino acid sequence selected from the group consisting of SEQ ID NOs: 13, 26, 39, 52, 71, 84, 97, 115, 128, and 335, or comprises 1, 2, 3, 4, 5, 1-2, 1-3, 1-4, 1-5, 1-10, 1-15, 1-20, 1-25, or 1-50 amino acid changes (i.e., amino acid substitutions, additions or deletions) relative to an amino acid sequence selected from the group consisting of SEQ ID NOs: 13, 26, 39, 52, 71, 84, 97, 115, 128, and 335;

(b) the light chain variable region comprises an amino acid sequence that is at least 80%, 85%, 90%, 95%, 96%, 97%, 98% or 99% identical to an amino acid sequence selected from the group consisting of SEQ ID NOs: 14, 27, 40, 53, 54, 72, 85, 98, 99, 116, 129, 130, and 336, or comprises 1, 2, 3, 4, 5, 1-2, 1-3, 1-4, 1-5, 1-10, 1-15, 1-20, 1-25, or 1-50 amino acid changes (i.e., amino acid substitutions, additions or deletions) relative to an amino acid sequence selected from the group consisting of SEQ ID NOs: 14, 27, 40, 53, 54, 72, 85, 98, 99, 116, 129, 130, and 336;

(c) the antibody specifically binds to GITR, and (d) the antibody exhibits 1, 2, 3, 4, 5, 6, 7, 8, 9, 10, 11, or all of the following functional properties:

(1) binding to soluble human GITR, e.g., with a $K_D$ of 10 nM or less (e.g., 0.01 nM to 10 nM), e.g., as measured by Biacore;

(2) binding to membrane bound human GITR, e.g., with a $K_D$ of 1 nM or less (e.g., 0.01 nM to 1 nM), e.g., as measured by Scatchard;

(3) binding to membrane bound human GITR, e.g., with an $EC_{50}$ of 1 nM or less (e.g., 0.01 nM to 1 nM), e.g., as measured by FACS;

(4) binding to cynomolgus GITR, e.g., bind to membrane bound cynomolgus GITR, e.g., with an $EC_{50}$ of 10 nM or less (e.g., 0.01 nM to 10 nM), e.g., as measured by FACS;

(5) inducing or enhancing T cell activation, such as in the presence of CD3 engagement (e.g., in the presence of suboptimal anti-CD3 concentrations), as evidenced, by (i) increased IL-2 and/or IFN-γ production in GITR-expressing T cells and/or (ii) enhanced T cell proliferation;

(6) inducing or enhancing T cell activation without requiring multivalent cross-linking;

(7) inhibiting the binding of GITR ligand to GITR on 3A9-hGITR cells, e.g., with an $EC_{50}$ of 1 μg/mL or less as measured by FACS;

(8) at most partially inhibiting the binding of GITR ligand to GITR on activated T cells;

(9) binding to a conformational epitope on mature human GITR (SEQ ID NO: 4), e.g., a discontinuous epitope within the amino acid sequences PTGGPGCGPGRLLLGTGT (SEQ ID NO: 217)
and

CRDYPGEE; (SEQ ID NO: 218)

(10) binding to both O-linked and N-linked glycosylated and unglycosylated human GITR;
(11) having agonist activity in the absence of binding to an Fc receptor, but wherein binding to an Fc receptor further enhances the agonist activity;
(12) competing in either direction or both directions for binding to human GITR with 28F3, 3C3-1, 3C3-2, 2G6, 8A6, 9G7-1, 9G7-2, 14E3, 19H8-1, 19H8-2, 19D3, 18E10, and 6G10.

In various embodiments, the antibody may exhibit one or more, two or more, three or more, four or more, five or more, six or more, seven or more, eight or more, nine, ten, eleven, or all of the functional properties listed as (1) through (12) above. The antibody can be, for example, a human antibody, a humanized antibody or a chimeric antibody.

An isolated anti-GITR antibody, or antigen binding portion thereof, may comprise a heavy chain and a light chain, wherein:

(a) the heavy chain comprises an amino acid sequence that is at least 80%, 85%, 90%, 95%, 96%, 97%, 98% or 99% identical to an amino acid sequence selected from the group consisting of SEQ ID NOs: 15, 17, 18, 28, 30, 31, 41, 43, 44, 55, 58, 59, 73, 75, 76, 86, 88, 89, 100, 102, 103, 117, 119, 120, 131, 134, 135, 227-275, 337, 339, 340, 348-352, 361, and 362, or comprises 1, 2, 3, 4, 5, 1-2, 1-3, 1-4, 1-5, 1-10, 1-15, 1-20, 1-25, or 1-50 amino acid changes (i.e., amino acid substitutions, additions or deletions) relative to an amino acid sequence selected from the group consisting of SEQ ID NOs: 15, 17, 18, 28, 30, 31, 41, 43, 44, 55, 58, 59, 73, 75, 76, 86, 88, 89, 100, 102, 103, 117, 119, 120, 131, 134, 135, 227-275, 337, 339, 340, 348-352, 361, and 362, with the proviso that, in certain embodiments, if the sequence is that of an effectorless heavy chain, the mutations rendering the heavy chain effectorless are not modified (i.e., no modification is made to A234, E235, A237, S330 and S331);

(b) the light chain comprises an amino acid sequence that is at least 80%, 85%, 90%, 95%, 96%, 97%, 98% or 99% identical to an amino acid sequence selected from the group consisting of SEQ ID NOs: 16, 19, 29, 32, 42, 45, 56, 57, 60, 61, 74, 87, 90, 101, 104, 105, 118, 121, 132, 133, 136, 137, 338, 341, and 371, or comprises 1, 2, 3, 4, 5, 1-2, 1-3, 1-4, 1-5, 1-10, 1-15, 1-20, 1-25, or 1-50 amino acid changes (i.e., amino acid substitutions, additions or deletions) relative to an amino acid sequence selected from the group consisting of SEQ ID NOs: 16, 19, 29, 32, 42, 45, 56, 57, 60, 61, 74, 87, 90, 101, 104, 105, 118, 121, 132, 133, 136, 137, 338, 341, and 371;

(c) the antibody specifically binds to GITR, and
(d) the antibody exhibits 1, 2, 3, 4, 5, 6, 7, 8, 9, 10, 11, or all of the following functional properties:

(1) binding to soluble human GITR, e.g., with a $K_D$ of 10 nM or less (e.g., 0.01 nM to 10 nM), e.g., as measured by Biacore;
(2) binding to membrane bound human GITR, e.g., with a $K_D$ of 1 nM or less (e.g., 0.01 nM to 1 nM), e.g., as measured by Scatchard;
(3) binding to membrane bound human GITR, e.g., with an $EC_{50}$ of 1 nM or less (e.g., 0.01 nM to 1 nM), e.g., as measured by FACS;
(4) binding to cynomolgus GITR, e.g., bind to membrane bound cynomolgus GITR, e.g., with an $EC_{50}$ of 10 nM or less (e.g., 0.01 nM to 10 nM), e.g., as measured by FACS;
(5) inducing or enhancing T cell activation, such as in the presence of CD3 engagement (e.g., in the presence of suboptimal anti-CD3 concentrations), as evidenced, by (i) increased IL-2 and/or IFN-γ production in GITR-expressing T cells and/or (ii) enhanced T cell proliferation;
(6) inducing or enhancing T cell activation without requiring multivalent cross-linking;
(7) inhibiting the binding of GITR ligand to GITR on 3A9-hGITR cells, e.g., with an $EC_{50}$ of 1 µg/mL or less as measured by FACS;
(8) at most partially inhibiting the binding of GITR ligand to GITR on activated T cells
(9) binding to a conformational epitope on mature human GITR (SEQ ID NO: 4), e.g., a discontinuous epitope within the amino acid sequences PTGGPGCGPGRLLLGTGT (SEQ ID NO: 217)
and

CRDYPGEE; (SEQ ID NO: 218)

(10) binding to both O-linked and N-linked glycosylated and unglycosylated human GITR
(11) having agonist activity in the absence of binding to an Fc receptor, but wherein binding to an Fc receptor further enhances the agonist activity; and
(12) competing in either direction or both directions for binding to human GITR with 28F3, 3C3-1, 3C3-2, 2G6, 8A6, 9G7-1, 9G7-2, 14E3, 19H8-1, 19H8-2, 19D3, 18E10, and 6G10.

Also provided are anti-GITR antibodies comprising a VHCDR1, VHCDR2, VHCDR3, VLCDR1, VLCDR2, and/or VLCDR3 that differs from the corresponding CDR of 28F3, 3C3-1, 3C3-2, 2G6, 8A6, 9G7-1, 9G7-2, 14E3, 19H8-1, 19H8-2, 19D3, 18E10, and/or 6G10, in 1, 2, 3, 4, 5, 1-2, 1-3, 1-4, or 1-5 amino acid changes (i.e., amino acid substitutions, additions or deletions). In certain embodiments, an anti-GITR antibody comprises 1-5 amino acid changes in each of 1, 2, 3, 4, 5 or 6 of the CDRs relative to the corresponding sequence in 28F3, 3C3-1, 3C3-2, 2G6, 8A6, 9G7-1, 9G7-2, 14E3, 19H8-1, 19H8-2, 19D3, 18E10, and/or 6G10. In certain embodiments, an anti-GITR antibody comprises at total of 1-5 amino acid changes across all CDRs relative to the CDRs in 28F3, 3C3-1, 3C3-2, 2G6, 8A6, 9G7-1, 9G7-2, 14E3, 19H8-1, 19H8-2, 19D3, 18E10, and/or 6G10.

In certain embodiments, an anti-GITR antibody comprises VH and VL CDRs consisting of those of 28F3, wherein one or more of the amino acids in one or more CDRs are those of one of the other anti-GITR antibodies disclosed herein.

For example, in certain embodiments, an anti-GITR antibody comprises a VHCDR1 comprising one or more amino acid modifications relative to SYGMH (SEQ ID NO: 20), and may comprise, e.g., one of the following degenerate sequences:

SYGXH (SEQ ID NO: 372), wherein X is any amino acid, e.g., M or F;

$X_1$YG$X_2$H, wherein $X_1$ is any amino acid, e.g., S, N or D; and $X_2$ is any amino acid, e.g., M or F; and $X_1YGX_2X_3$, wherein $X_1$ is any amino acid, e.g., S, N or D; $X_2$ is any amino acid, e.g., M or F, and $X_3$ is any amino acid, e.g., H or Q.

In certain embodiments, an anti-GITR antibody comprises a VHCDR2 comprising one or more amino acid modifications relative to VIWYEGSNKYYADSVKG (SEQ ID NO: 21), and may comprise one of the following degenerate sequences:

VIWYX$_1$GSNKX$_2$YADSVKG (SEQ ID NO: 373), wherein $X_1$ is any amino acid, e.g., E or A; and $X_2$ is any amino acid, e.g., Y or F; and VIWYX$_1$GSNKX$_2$YX$_3$DSVKG (SEQ ID NO: 374), wherein $X_1$ is any amino acid, e.g., E, A, G or D; $X_2$ is any amino acid, e.g., Y or F; and $X_3$ is any amino acid, e.g., A or V.

In certain embodiments, an anti-GITR antibody comprises a VHCDR3 comprising one or more amino acid modifications relative to GGSMVRGDYYYGMDV (SEQ ID NO: 22), and may comprise, e.g., one of the following degenerate sequences:

GGSX$_1$VRGDYYYGMDV (SEQ ID NO: 375), wherein $X_1$ is any amino acid, e.g., M or V, L, I or A.

GGSX$_1$VRGX$_2$YYYGMDV (SEQ ID NO: 376), wherein $X_1$ is any amino acid, e.g., M or V, L, I or A; and $X_2$ is any amino acid, e.g., D or E. Particular combinations of $X_1$ and $X_2$ are set forth in the Examples.

GG (6-7aa) MDVWYYX$_1$MDVW (SEQ ID NO: 377), wherein $X_1$ is any amino acid, e.g., G, S or V. In certain embodiments, the 6-7 amino acids correspond to the amino acids at that position in a VHCDR3 sequence of an anti-GITR antibody disclosed herein.

In certain embodiments, an anti-GITR antibody comprises a VLCDR1 comprising one or more amino acid modifications relative to RASQGISSALA (SEQ ID NO: 23), and may comprise, e.g., one of the following degenerate sequences:

RASQGISSXLA (SEQ ID NO: 378), wherein X is any amino acid, e.g., A or W (or A, W or Y); and RASQG (2-3 aa) SX$_1$LA (SEQ ID NO: 379), wherein $X_1$ is any amino acid, e.g., W, Y or A and the 2-3 amino acids are any amino acids, e.g., GI, SVS or SVT.

In certain embodiments, an anti-GITR antibody comprises a VLCDR2 comprising one or more amino acid modifications relative to DASSLES (SEQ ID NO: 24), and may comprise, e.g., one of the following degenerate sequences:

DASSLXS (SEQ ID NO: 380), wherein X is any amino acid, e.g., E or Q; and $X_1$ASSX$_2$X$_3$X$_4$, wherein $X_1$ is any amino acid, e.g., A, D or G; $X_4$ is any amino acid, e.g., L or R; $X_3$ is any amino acid, e.g., Q, E or A; and $X_4$ is any amino acid, e.g., S or T.

In certain embodiments, an anti-GITR antibody comprises a VLCDR3 comprising one or more amino acid modifications relative to QQFNSYPYT (SEQ ID NO: 25), and may comprise, e.g., one of the following degenerate sequences:

QQXNSYPYT (SEQ ID NO: 381), wherein X is any amino acid, e.g., F or Y; and

QQX$_1$X$_2$SX$_3$PX$_4$T (SEQ ID NO: 382), wherein $X_1$ is any amino acid, e.g., F or Y; $X_2$ is any amino acid, e.g., N or G; $X_3$ is any amino acid, e.g., Y or S; and $X_4$ is any amino acid, e.g., Y, W, I, P or Q.

Antibodies having sequences with homology to those of 28F3, 3C3, 2G6, 8A6, 9G7, 14E3, 19H8, 19D3, 18E10, and/or 6G10, e.g., the $V_H$ and $V_L$ regions of SEQ ID NOs: 13, 26, 39, 52, 71, 84, 97, 115, 128, and 335, and SEQ ID NOs: 14, 27, 40, 53, 54, 72, 85, 98, 99, 116, 129, 130, and 336, respectively, or heavy and light chains of SEQ ID NOs: 15, 17, 18, 28, 30, 31, 41, 43, 44, 55, 58, 59, 73, 75, 76, 86, 88, 89, 100, 102, 103, 117, 119, 120, 131, 134, 135, and 337, and SEQ ID NOs: 16, 19, 29, 32, 42, 45, 56, 60, 61, 74, 87, 90, 101, 104, 105, 118, 121, 132, 133, 136, 137, and 338, respectively, or CDRs can be obtained by mutagenesis (e.g., site-directed or PCR-mediated mutagenesis) of nucleic acid molecules encoding SEQ ID NOs: 147, 154, 158, 162, 168, 172, 176, 182, 186, 353 and/or SEQ ID NOs: 148, 155, 159, 163, 164, 169, 173, 177, 178, 183, 187, 188, 354 or SEQ ID NOs: 149, 151, 152, 156, 160, 165, 170, 174, 179, 184, 189, 355 and/or SEQ ID NOs: 150, 153, 157, 161, 166, 171, 175, 180, 185, 190, 191, 356, followed by testing of the encoded altered antibody for retained function (i.e., the functions set forth in (1) through (12) above) using the functional assays described herein.

V. Antibodies with Conservative Modifications

Anti-GITR antibodies may comprise a heavy chain variable region comprising CDR1, CDR2 and CDR3 sequences and a light chain variable region comprising CDR1, CDR2 and CDR3 sequences, wherein one or more of these CDR sequences comprise specified amino acid sequences based on the preferred antibodies described herein (e.g., 28F3, 19D3, 18E10, 3C3, 2G6, 8A6, 9G7, 14E3, 19H8, and 6G10), or conservative modifications thereof, and wherein the antibodies retain the desired functional properties of the anti-GITR antibodies described herein. Accordingly, an isolated anti-GITR antibody, or antigen binding portion thereof, may comprise a heavy chain variable region comprising CDR1, CDR2, and CDR3 sequences and a light chain variable region comprising CDR1, CDR2, and CDR3 sequences, wherein:

(a) the heavy chain variable region CDR3 sequence comprises an amino acid sequence selected from the group consisting of amino acid sequences of SEQ ID NOs: 22, 35, 48, 64, 80, 93, 108, 124, 140, and 344, and conservative modifications thereof, e.g., 1, 2, 3, 4, 5, 1-2, 1-3, 1-4 or 1-5 conservative amino acid substitutions;

(b) the light chain variable region CDR3 sequence comprises an amino acid sequence selected from the group consisting of amino acid sequence of SEQ ID NOs: 25, 38, 51, 67, 70, 83, 96, 111, 114, 127, 143, 146, and 347, and conservative modifications thereof, e.g., 1, 2, 3, 4, 5, 1-2, 1-3, 1-4 or 1-5 conservative amino acid substitutions;

(c) the antibody specifically binds to GITR, and (d) the antibody exhibits 1, 2, 3, 4, 5, 6, 7, 8, 9, 10, 11, or all of the following functional properties:

(1) binding to soluble human GITR, e.g., with a $K_D$ of 10 nM or less (e.g., 0.01 nM to 10 nM), e.g., as measured by Biacore;

(2) binding to membrane bound human GITR, e.g., with a $K_D$ of 1 nM or less (e.g., 0.01 nM to 1 nM), e.g., as measured by Scatchard;

(3) binding to membrane bound human GITR, e.g., with an $EC_{50}$ of 1 nM or less (e.g., 0.01 nM to 1 nM), e.g., as measured by FACS;

(4) binding to cynomolgus GITR, e.g., bind to membrane bound cynomolgus GITR, e.g., with an $EC_{50}$ of 10 nM or less (e.g., 0.01 nM to 10 nM), e.g., as measured by FACS;

(5) inducing or enhancing T cell activation, such as in the presence of CD3 engagement (e.g., in the presence of suboptimal anti-CD3 concentrations), as evidenced by (i) increased IL-2 and/or IFN-γ production in GITR-expressing T cells and/or (ii) enhanced T cell proliferation;
(6) inducing or enhancing T cell activation without requiring multivalent cross-linking;
(7) inhibiting the binding of GITR ligand to GITR on 3A9-hGITR cells, e.g., with an $EC_{50}$ of 1 µg/mL or less as measured by FACS;
(8) at most partially inhibiting the binding of GITR ligand to GITR on activated T cells;
(9) binding to a conformational epitope on mature human GITR (SEQ ID NO: 4), e.g., a discontinuous epitope within the amino acid sequences PTGGPGCGPGRLLLGTGT (SEQ ID NO: 217)
and
CRDYPGEE; (SEQ ID NO: 218)

(10) binding to both O-linked and N-linked glycosylated and unglycosylated human GITR;
(11) having agonist activity in the absence of binding to an Fc receptor, but wherein binding to an Fc receptor further enhances the agonist activity; and
(12) competing in either direction or both directions for binding to human GITR with 28F3, 3C3-1, 3C3-2, 2G6, 8A6, 9G7-1, 9G7-2, 14E3, 19H8-1, 19H8-2, 19D3, 18E10, and/or 6G10.

In a preferred embodiment, the heavy chain variable region CDR2 sequence comprises an amino acid sequence selected from the group consisting of amino acid sequences of SEQ ID NOs: 21, 34, 47, 63, 79, 92, 107, 123, 139, and 343, and conservative modifications thereof, e.g., 1, 2, 3, 4, 5, 1-2, 1-3, 1-4 or 1-5 conservative amino acid substitutions; and the light chain variable region CDR2 sequence comprises an amino acid sequence selected from the group consisting of amino acid sequences of SEQ ID NOs: 24, 37, 50, 66, 69, 82, 95, 110, 113, 126, 142, 145, and 346, and conservative modifications thereof, e.g., 1, 2, 3, 4, 5, 1-2, 1-3, 1-4 or 1-5 conservative amino acid substitutions. In another preferred embodiment, the heavy chain variable region CDR1 sequence comprises an amino acid sequence selected from the group consisting of amino acid sequences of SEQ ID NOs: 20, 33, 46, 62, 78, 91, 106, 122, 138, and 342, and conservative modifications thereof, e.g., 1, 2, 3, 4, 5, 1-2, 1-3, 1-4 or 1-5 conservative amino acid substitutions; and the light chain variable region CDR1 sequence comprises an amino acid sequence selected from the group consisting of amino acid sequences of SEQ ID NOs: 23, 36, 49, 65, 68, 81, 94, 109, 112, 125, 141, 144, and 345, and conservative modifications thereof, e.g., 1, 2, 3, 4, 5, 1-2, 1-3, 1-4 or 1-5 conservative amino acid substitutions.

In various embodiments, the antibody may exhibit one or more, two or more, three or more, four or more, five or more, six or more, seven or more, eight or more, nine, or all of the functional properties listed as (1) through (12) above. Such antibodies can be, for example, human antibodies, humanized antibodies or chimeric antibodies.

Conservative amino acid substitutions may also be made in portions of the antibodies other than, or in addition to, the CDRs. For example, conservative amino acid modifications may be made in a framework region or in the Fc region. A variable region or a heavy or light chain may comprise 1, 2, 3, 4, 5, 1-2, 1-3, 1-4, 1-5, 1-10, 1-15, 1-20, 1-25, or 1-50 conservative amino acid substitutions relative to the anti-GITR antibody sequences provided herein. In certain embodiments, an anti-GITR antibody comprises a combination of conservative and non-conservative amino acid modification.

VI. Antibodies that Bind the Same Epitope on GITR as, or Compete for Binding to GITR with, the Antibodies Described Herein Also provided are antibodies that compete for binding to GITR with the particular anti-GITR antibodies described herein (e.g., antibodies 28F3, 19D3, 18E10, 3C3, 2G6, 8A6, 9G7, 14E3, 19H8, and 6G10). Such competing antibodies can be identified based on their ability to competitively inhibit binding to GITR of one or more of monoclonal antibodies 28F3, 19D3, 18E10, 3C3-1, 3C3-2, 2G6, 8A6, 9G7-1, 9G7-2, 14E3, 19H8-1, 19H8-2, and 6G10 in standard GITR binding assays. For example, standard ELISA assays or competitive ELISA assays can be used in which a recombinant human GITR protein is immobilized on the plate, various concentrations of unlabeled first antibody is added, the plate is washed, labeled second antibody is added, and the amount of label is measured. If the increasing concentration of the unlabeled (first) antibody (also referred to as the "blocking antibody") inhibits the binding of the labeled (second) antibody, the first antibody is said to inhibit the binding of the second antibody to the target on the plate, or is said to compete with the binding of the second antibody. Additionally or alternatively, BIAcore analysis can be used to assess the ability of the antibodies to compete. The ability of a test antibody to inhibit the binding of an anti-GITR antibody described herein to GITR demonstrates that the test antibody can compete with the antibody for binding to GITR.

Accordingly, provided herein are anti-GITR antibodies that inhibit the binding of an anti-GITR antibodies described herein to GITR on cells, e.g., activated T cells, by at least 10%, 20%, 30%, 40%, 50%, 55%, 60%, 65%, 70%, 75%, 80%, 85%, 90%, 91%, 92%, 93%, 94%, 95%, 96%, 97%, 98%, 99%, or 100% and/or whose binding to GITR on cells, e.g., activated T cells, is inhibited by at least 10%, 20%, 30%, 40%, 50%, 55%, 60%, 65%, 70%, 75%, 80%, 85%, 90%, 91%, 92%, 93%, 94%, 95%, 96%, 97%, 98%, 99%, or 100%, e.g., as measured by ELISA or FACS, such as by using the assay described in the following paragraph.

An exemplary competition experiment to determine, e.g., whether a first antibody blocks the binding of (i.e., "competes with") a second antibody, may be conducted as follows: activated human T cells are prepared as follows: Peripheral Blood Mononuclear Cells (PBMCs) are isolated from human whole blood using Ficoll gradient and activated with 10 µg/mL phytohaemagglutinin (PHA-L) (USBiol #P3370-30) and 200IU/mL recombinant IL-2 (Peprotech #200-02) for 3 days. The activated T cells are resuspended in FACS buffer (PBS with 5% Fetal Bovine Serum) and seeded at $10^5$ cells per sample well in a 96 well plate. The plate is set on ice followed by the addition of unconjugated first antibody at concentrations ranging from 0 to 50 µg/mL (three-fold titration starting from a highest concentration of 50 µg/mL). An unrelated IgG may be used as an isotype control for the first antibody and added at the same concentrations (three-fold titration starting from a highest concentration of 50 µg/mL). A sample pre-incubated with 50 µg/mL unlabeled second antibody may be included as a positive control for complete blocking (100% inhibition) and a sample without antibody in the primary incubation may be used as a negative control (no competition; 0% inhibition). After 30 minutes of incubation, labeled, e.g., biotinylated, second antibody is added at a concentration of 2 µg/mL per well without washing. Samples are incubated for another 30 minutes on ice. Unbound antibodies are removed by washing the cells with FACS buffer. Cell-bound labeled second antibody is detected with an agent that detects the label, e.g., PE conjugated streptavidin (Invitrogen, catalog #521388) for detecting biotin. The samples are acquired on a FACS Calibur Flow Cytometer (BD, San Jose) and analyzed with Flowjo software (Tree Star, Inc, Ashland, Oreg.). The results may be represented as the % inhibition (i.e., subtracting from 100% the amount of label at each concentration divided by the amount of label obtained with no blocking antibody). Typically, the same experiment is then conducted in the reverse, i.e., the first antibody is the second antibody and the second antibody is the first antibody. In certain embodiments, an antibody at least partially (e.g., at least 10%, 20%, 30%, 40%, 50%, 60%, 70%, 80%, or 90%) or completely (100%) blocks the binding of the other antibody to the target, e.g. human GITR or portion thereof, and regardless of whether inhibition occurs when one or the other antibody is the first antibody. A first and a second antibody "cross-block" binding of each other to the target, when the antibodies compete with each other both ways, i.e., in competition experiments in which the first antibody is added first and in competition experiments in which the second antibody is added first. In certain embodiments, anti-GITR antibodies bind to the same epitope as that of the anti-GITR antibodies described herein (e.g., antibodies 28F3, 19D3, 18E10, 3C3-1, 3C3-2, 2G6, 8A6, 9G7-1, 9G7-2, 14E3, 19H8-1, 19H8-2, and 6G10), e.g., as determined by a given epitope mapping technique. As discussed further herein, the 28F3 antibody binds within a region in human GITR within QRPTGGPGCGPGRLLLGTGT-DARCCRVHTTRCCRDYPGE (SEQ ID NO: 215). Accordingly, in certain embodiments, an anti-GITR antibody binds to amino acid residues within the region QRPTGGPGCGPGRLLLGTGTDARCCRVHTTRC-CRDYPGE (SEQ ID NO: 215), corresponding to amino acid residues 1-39 of mature human GITR (SEQ ID NO: 4). In one embodiment, the anti-GITR antibody binds to amino acid residues within the region QRPTGGPGCGPGRLLLGTGT (SEQ ID NO: 216) of mature human GITR. In one embodiment, the anti-GITR antibodies described herein binds to amino acid residues within the region PTGGPGCGPGRLLLGTGT (SEQ ID NO: 217) and CRDYPGEE (SEQ ID NO: 218) of mature human GITR. In certain embodiments, anti-GITR antibodies bind to amino acid sequences PTGGPGCGPGRLLLGTGT (SEQ ID NO: 217) and CRDYPGEE (SEQ ID NO: 218), as determined by HDX, e.g., using the protocol set forth in the Examples.

Techniques for determining antibodies that bind to the "same epitope on GITR" with the antibodies described herein include, for example, epitope mapping methods, such as, x-ray analyses of crystals of antigen:antibody complexes which provides atomic resolution of the epitope. Other methods monitor the binding of the antibody to antigen fragments or mutated variations of the antigen where loss of binding due to a modification of an amino acid residue within the antigen sequence is often considered an indication of an epitope component. In addition, computational combinatorial methods for epitope mapping can also be used. Methods may also rely on the ability of an antibody of interest to affinity isolate specific short peptides (either in native three dimensional form or in denatured form) from combinatorial phage display peptide libraries. The peptides are then regarded as leads for the definition of the epitope corresponding to the antibody used to screen the peptide library. For epitope mapping, computational algorithms have also been developed which have been shown to map conformational discontinuous epitopes.

Antibodies that compete for binding with, or bind to the same epitope as, the anti-GITR antibodies described herein may be identified by using art-known methods. For example, mice may be immunized with human GITR as described herein, hybridomas produced, and the resulting monoclonal antibodies screened for the ability to compete with an antibody described herein for binding to GITR. Mice can also be immunized with a smaller fragment of GITR containing the epitope to which the antibody binds. The epitope or region comprising the epitope can be localized by, e.g., screening for binding to a series of overlapping peptides spanning GITR. Alternatively, the method of Jespers et al., Biotechnology 12:899, 1994 may be used to guide the selection of antibodies having the same epitope and therefore similar properties to the an anti-GITR antibody described herein. Using phage display, first the heavy chain of the anti-GITR antibody is paired with a repertoire of (preferably human) light chains to select a GITR-binding antibody, and then the new light chain is paired with a repertoire of (preferably human) heavy chains to select a (preferably human) GITR-binding antibody having the same epitope or epitope region as an anti-GITR antibody described herein. Alternatively variants of an antibody described herein can be obtained by mutagenesis of cDNA encoding the heavy and light chains of the antibody.

Alanine scanning mutagenesis, as described by Cunningham and Wells (1989) Science 244: 1081-1085, or some other form of point mutagenesis of amino acid residues in GITR may also be used to determine the functional epitope for an anti-GITR antibody. Mutagenesis studies, however, may also reveal amino acid residues that are crucial to the overall three-dimensional structure of GITR but that are not directly involved in antibody-antigen contacts, and thus other methods may be necessary to confirm a functional epitope determined using this method.

The epitope or epitope region (an "epitope region" is a region comprising the epitope or overlapping with the epitope) bound by a specific antibody may also be determined by assessing binding of the antibody to peptides comprising fragments of GITR, e.g., non-denatured or denatured fragments. A series of overlapping peptides encompassing the sequence of GITR (e.g., human GITR) may be synthesized and screened for binding, e.g. in a direct ELISA, a competitive ELISA (where the peptide is assessed for its ability to prevent binding of an antibody to GITR bound to a well of a microtiter plate), or on a chip. Such peptide screening methods may not be capable of detecting some discontinuous functional epitopes, i.e. functional epitopes that involve amino acid residues that are not contiguous along the primary sequence of the GITR polypeptide chain.

An epitope may also be identified by MS-based protein footprinting, such as Hydrogen/deuterium exchange mass spectrometry (HDX-MS) and Fast Photochemical Oxidation of Proteins (FPOP). HDX-MS may be conducted, e.g., as further described in the Examples and in Wei et al. (2014) Drug Discovery Today 19:95, the methods of which are specifically incorporated by reference herein. FPOP may be conducted as described, e.g., in Hambley and Gross (2005) J. American Soc. Mass Spectrometry 16:2057, the methods of which are specifically incorporated by reference herein.

The epitope bound by anti-GITR antibodies may also be determined by structural methods, such as X-ray crystal structure determination (e.g., WO2005/044853), molecular modeling and nuclear magnetic resonance (NMR) spectroscopy, including NMR determination of the H-D exchange rates of labile amide hydrogens in GITR when free and when bound in a complex with an antibody of interest (Zinn-Justin et al. (1992) Biochemistry 31, 11335-11347; Zinn-Justin et al. (1993) Biochemistry 32, 6884-6891).

With regard to X-ray crystallography, crystallization may be accomplished using any of the known methods in the art (e.g. Giege et al. (1994) Acta Crystallogr. D50:339-350; McPherson (1990) Eur. J. Biochem. 189:1-23), including microbatch (e.g. Chayen (1997) Structure 5:1269-1274), hanging-drop vapor diffusion (e.g. McPherson (1976) J. Biol. Chem. 251:6300-6303), seeding and dialysis. It is desirable to use a protein preparation having a concentration of at least about 1 mg/mL and preferably about 10 mg/mL to about 20 mg/mL. Crystallization may be best achieved in a precipitant solution containing polyethylene glycol 1000-20,000 (PEG; average molecular weight ranging from about 1000 to about 20,000 Da), preferably about 5000 to about 7000 Da, more preferably about 6000 Da, with concentrations ranging from about 10% to about 30% (w/v). It may also be desirable to include a protein stabilizing agent, e.g. glycerol at a concentration ranging from about 0.5% to about 20%. A suitable salt, such as sodium chloride, lithium chloride or sodium citrate may also be desirable in the precipitant solution, preferably in a concentration ranging from about 1 mM to about 1000 mM. The precipitant is preferably buffered to a pH of from about 3.0 to about 5.0, preferably about 4.0. Specific buffers useful in the precipitant solution may vary and are well-known in the art (Scopes, Protein Purification: Principles and Practice, Third ed., (1994) Springer-Verlag, New York). Examples of useful buffers include, but are not limited to, HEPES, Tris, MES and acetate. Crystals may be grow at a wide range of temperatures, including 2° C., 4° C., 8° C. and 26° C.

Antibody:antigen crystals may be studied using well-known X-ray diffraction techniques and may be refined using computer software such as X-PLOR (Yale University, 1992, distributed by Molecular Simulations, Inc.; see e.g. Blundell & Johnson (1985) Meth. Enzymol. 114 & 115, H. W. Wyckoff et al., eds., Academic Press; U.S. Patent Application Publication No. 2004/0014194), and BUSTER (Bricogne (1993) Acta Cryst. D49:37-60; Bricogne (1997) Meth. Enzymol. 276A:361-423, Carter & Sweet, eds.; Roversi et al. (2000) Acta Cryst. D56:1313-1323), the disclosures of which are hereby incorporated by reference in their entireties.

Anti-GITR antibodies may bind to the same epitope as any of the anti-GITR antibodies having amino acid sequences described herein, as determined by an epitope mapping technique, such as a technique described herein.

VII. Engineered and Modified Antibodies

VH and VL Regions

Also provided are engineered and modified antibodies that can be prepared using an antibody having one or more of the $V_H$ and/or $V_L$ sequences disclosed herein as starting material to engineer a modified antibody, which modified antibody may have altered properties from the starting antibody. An antibody can be engineered by modifying one or more residues within one or both variable regions (i.e., $V_H$ and/or $V_L$), for example within one or more CDR regions and/or within one or more framework regions. Additionally or alternatively, an antibody can be engineered by modifying residues within the constant region(s), for example to alter the effector function(s) of the antibody.

One type of variable region engineering that can be performed is CDR grafting. Antibodies interact with target antigens predominantly through amino acid residues that are located in the six heavy and light chain complementarity determining regions (CDRs). For this reason, the amino acid sequences within CDRs are more diverse between individual antibodies than sequences outside of CDRs. Because CDR sequences are responsible for most antibody-antigen interactions, it is possible to express recombinant antibodies that mimic the properties of specific naturally occurring antibodies by constructing expression vectors that include CDR sequences from the specific naturally occurring antibody grafted onto framework sequences from a different antibody with different properties (see, e.g., Riechmann, L. et al. (1998) Nature 332:323-327; Jones, P. et al. (1986) Nature 321:522-525; Queen, C. et al. (1989) Proc. Natl. Acad. See. U.S.A. 86:10029-10033; U.S. Pat. No. 5,225,539 to Winter, and U.S. Pat. Nos. 5,530,101; 5,585,089; 5,693,762 and 6,180,370 to Queen et al.)

Accordingly, another embodiment described herein pertains to an isolated monoclonal antibody, or antigen binding portion thereof, comprising a heavy chain variable region comprising CDR1, CDR2, and CDR3 sequences comprising an amino acid sequence selected from the group consisting of SEQ ID NOs: 20, 33, 46, 62, 78, 91, 106, 122, 138, and 342, SEQ ID NOs: 21, 34, 47, 63, 79, 92, 107, 123, 139, and 343, and SEQ ID NOs: 22, 35, 48, 64, 80, 93, 108, 124, 140, and 344, respectively, and a light chain variable region comprising CDR1, CDR2, and CDR3 sequences comprising an amino acid sequence selected from the group consisting of SEQ ID NOs: 23, 36, 49, 65, 68, 81, 94, 109, 112, 125, 141, 144, and 345, SEQ ID NOs: 24, 37, 50, 66, 69, 82, 95, 110, 113, 126, 142, 145, and 346, and SEQ ID NOs: 25, 38, 51, 67, 70, 83, 96, 111, 114, 127, 143, 146, and 347, respectively. Thus, such antibodies contain the $V_H$ and $V_L$ CDR sequences of monoclonal antibodies 28F3, 19D3, 18E10, 3C3-1, 3C3-2, 2G6, 8A6, 9G7-1, 9G7-2, 14E3, 19H8-1, 19H8-2, and 6G10, yet may contain different framework sequences from these antibodies.

Such framework sequences can be obtained from public DNA databases or published references that include germline antibody gene sequences. For example, germline DNA sequences for human heavy and light chain variable region genes can be found in the "VBase" human germline sequence database (available on the Internet at www.mrc-cpe.cam.ac.uk/vbase), as well as in Kabat, E. A., et al. (1991) Sequences of Proteins of Immunological Interest, Fifth Edition, U.S. Department of Health and Human Services, NIH Publication No. 91-3242; Tomlinson, I. M., et al. (1992) "The Repertoire of Human Germline $V_H$ Sequences Reveals about Fifty Groups of $V_H$ Segments with Different Hypervariable Loops" J. Mol. Biol. 227:776-798; and Cox, J. P. L. et al. (1994) "A Directory of Human Germ-line $V_H$ Segments Reveals a Strong Bias in their Usage" Eur. J. Immunol. 24:827-836; the contents of each of which are expressly incorporated herein by reference.

Preferred framework sequences for use in the antibodies described herein are those that are structurally similar to the framework sequences used by antibodies described herein. The $V_H$ CDR1, 2 and 3 sequences, and the $V_L$ CDR1, 2 and 3 sequences, can be grafted onto framework regions that have the identical sequence as that found in the germline immunoglobulin gene from which the framework sequence derive, or the CDR sequences can be grafted onto framework regions that contain one or more mutations as compared to the germline sequences. For example, it has been found that in certain instances it is beneficial to mutate residues within the framework regions to maintain or enhance the antigen binding ability of the antibody (see e.g., U.S. Pat. Nos. 5,530,101; 5,585,089; 5,693,762 and 6,180,370 to Queen et al).

Engineered antibodies described herein include those in which modifications have been made to framework residues within $V_H$ and/or $V_L$, e.g. to improve the properties of the antibody. Typically such framework modifications are made to decrease the immunogenicity of the antibody. For example, one approach is to "backmutate" one or more framework residues to the corresponding germline sequence. More specifically, an antibody that has undergone somatic mutation may contain framework residues that differ from the germline sequence from which the antibody is derived. Such residues can be identified by comparing the antibody framework sequences to the germline sequences from which the antibody is derived. To return the framework region sequences to their germline configuration, the somatic mutations can be "backmutated" to the germline sequence by, for example, site-directed mutagenesis or PCR-mediated mutagenesis. Such "backmutated" antibodies are also intended to be encompassed. Another type of framework modification involves mutating one or more residues within the framework region, or even within one or more CDR regions, to remove T cell epitopes to thereby reduce the potential immunogenicity of the antibody. This approach is also referred to as "deimmunization" and is described in further detail in U.S. Patent Publication No. 20030153043 by Carr et al.

Another type of variable region modification is to mutate amino acid residues within the $V_H$ and/or $V_L$ CDR1, CDR2 and/or CDR3 regions to thereby improve one or more binding properties (e.g., affinity) of the antibody of interest. Site-directed mutagenesis or PCR-mediated mutagenesis can be performed to introduce the mutation(s) and the effect on antibody binding, or other functional property of interest, can be evaluated in in vitro or in vivo assays as described herein and provided in the Examples. Preferably conservative modifications (as discussed above) are introduced. The mutations may be amino acid substitutions, additions or deletions, but are preferably substitutions. Moreover, typically no more than one, two, three, four or five residues within a CDR region are altered.

Accordingly, also provided are isolated anti-GITR monoclonal antibodies, or antigen binding portions thereof, comprising a heavy chain variable region comprising: (a) a $V_H$ CDR1 region comprising an amino acid sequence selected from the group consisting of SEQ ID NOs: 20, 33, 46, 62, 78, 91, 106, 122, 138, and 342, or an amino acid sequence having one, two, three, four or five amino acid substitutions, deletions or additions as compared to SEQ ID NOs: 20, 33, 46, 62, 78, 91, 106, 122, 138, and 342; (b) a $V_H$ CDR2 region comprising an amino acid sequence selected from the group consisting of SEQ ID NOs: 21, 34, 47, 63, 79, 92, 107, 123, 139, and 343, or an amino acid sequence having one, two, three, four or five amino acid substitutions, deletions or additions as compared to SEQ ID NOs: 21, 34, 47, 63, 79, 92, 107, 123, 139, and 343; (c) a $V_H$ CDR3 region comprising an amino acid sequence selected from the group consisting of SEQ ID NOs: 22, 35, 48, 64, 80, 93, 108, 124, 140, and 344, or an amino acid sequence having one, two, three, four or five amino acid substitutions, deletions or additions as compared to SEQ ID NOs: 22, 35, 48, 64, 80, 93, 108, 124, 140, and 344; (d) a $V_L$ CDR1 region comprising an amino acid sequence selected from the group consisting of SEQ ID NOs: 23, 36, 49, 65, 68, 81, 94, 109, 112, 125, 141, 144, and 345, or an amino acid sequence having one, two, three, four or five amino acid substitutions, dele-tions or additions as compared to SEQ ID NOs: 23, 36, 49, 65, 68, 81, 94, 109, 112, 125, 141, 144, and 345; (e) a $V_L$ CDR2 region comprising an amino acid sequence selected from the group consisting of SEQ ID NOs: 24, 37, 50, 66, 69, 82, 95, 110, 113, 126, 142, 145, and 346, or an amino acid sequence having one, two, three, four or five amino acid substitutions, deletions or additions as compared to SEQ ID NOs: 24, 37, 50, 66, 69, 82, 95, 110, 113, 126, 142, 145, and 346; and (f) a $V_L$ CDR3 region comprising an amino acid sequence selected from the group consisting of SEQ ID NOs: 25, 38, 51, 67, 70, 83, 96, 111, 114, 127, 143, 146, and 347, or an amino acid sequence having one, two, three, four or five amino acid substitutions, deletions or additions as compared to SEQ ID NOs: 25, 38, 51, 67, 70, 83, 96, 111, 114, 127, 143, 146, and 347.

Methionine residues in CDRs of antibodies can be oxidized, resulting in potential chemical degradation and consequent reduction in potency of the antibody. Accordingly, also provided are anti-GITR antibodies which have one or more methionine residues in the heavy and/or light chain CDRs replaced with amino acid residues which do not undergo oxidative degradation. In one embodiment, the methionine residues in the CDRs of antibodies 28F3, 18E10, 19D3, and 6G10 are replaced with amino acid residues which do not undergo oxidative degradation.

Similarly, deamidation sites may be removed from anti-GITR antibodies, particularly in the CDRs.

Fcs and Modified Fcs

Anti-GITR variable regions described herein may be linked (e.g., covalently linked or fused) to an Fc, e.g., an IgG1, IgG2, IgG3 or IgG4 Fc, which may be of any allotype or isoallotype, e.g., for IgG1: G1m, G1m1(a), G1m2(x), G1m3(f), G1m17(z); for IgG2: G2m, G2m23(n); for IgG3: G3m, G3m21(g1), G3m28(g5), G3m11(b0), G3m5(b1), G3m13(b3), G3m14(b4), G3m10(b5), G3m15(s), G3m16 (t), G3m6(c3), G3m24(c5), G3m26(u), G3m27(v); and for K: Km, Km1, Km2, Km3 (see, e.g., Jefferies et al. (2009) mAbs 1:1).

In certain embodiments, anti-GITR variable regions described herein are linked to an Fc that binds to one or more activating Fc receptors (FcγI, FcγIIa or FcγIIIa), and thereby stimulate ADCC and may cause T cell depletion. In certain embodiments, anti-GITR variable regions described herein are linked to an Fc that causes depletion. As further described in the Examples (Examples 16 and 17), mouse IgG2a and rat IgG2b isotypes (equivalent to mouse IgG2a in binding to mouse activating FcRs) induced the greatest inhibition of tumor growth in several mouse tumor models. The anti-GITR mG2a, mG2b and rG2b isotypes had little effect on, or induced small increases in Treg populations in the periphery versus inducing significant Treg depletion in the tumor environment, which correlated with tumor growth inhibition. Conversely, the mIgG2a isotype caused an increase in the percentage of CD8+ cells at the tumor site, whereas the mIgG1 and rat IgG2b caused no, or only marginal increase in, the percentage of CD8+ cells. Accordingly, in certain embodiments, anti-GITR variable regions described herein are linked to a human IgG1 or IgG3 Fc, i.e., the antibodies are of the IgG1 or IgG3 isotype. In certain embodiments, anti-GITR antibodies are depleting antibodies, in particular, they deplete $T_{reg}$ cells that are in the tumor microenvironment (and thereby enhance anti-tumor activity), but do not significantly deplete $T_{eff}$ cells that are in the tumor microenvironment and mediate the anti-tumor effect, and/or do not significantly deplete $T_{reg}$ and $T_{eff}$ cells that are outside of the tumor, e.g., in the periphery. In certain embodiments, anti-GITR antibodies are of an isotype, (either naturally occurring or non-naturally occurring (e.g., including mutation(s)) isotype that stimulate $T_{reg}$ cell depletion or elimination at the tumor site and concomitant activation of $T_{eff}$ cells. In certain embodiments, anti-GITR antibodies create an elevated $T_{eff}$ to $T_{reg}$ ratio at the tumor site, which is indicative of potent anti-tumor activity, and preferably without significantly depleting $T_{reg}$ and $T_{eff}$ cells that are outside of the tumor, e.g., in the periphery. In certain embodiments, anti-GITR antibodies block the immunosuppressive activity of Tregs. In certain embodiments, anti-GITR antibodies have an Fc receptor with no, or with reduced, FcR binding, e.g., reduced binding to activating FcRs. In certain embodiments, anti-GITR antibodies have an Fc that binds to or has enhanced binding to FcRIIb, which can provide enhanced agonism.

In certain embodiments, the potency of an anti-GITR antibody to potentiate an endogenous immune response is enhanced, optimized or maximized by a method comprising selecting, designing or modifying the Fc region of the antibody so as to enhance the binding of said Fc region to an activating Fc receptor. In one embodiment, the anti-GITR antibody is TRX-518.

In certain embodiments, anti-GITR variable regions described herein are linked to an effectorless or mostly effectorless Fc, e.g., IgG2 or IgG4.

Anti-GITR variable regions described herein may be linked to a non-naturally occurring Fc region, e.g., an effectorless Fc or an Fc with enhanced binding to one or more activating Fc receptors (FcγI, FcγIIa or FcγIIIa), such as to enhance $T_{reg}$ depletion in the tumor environment.

Generally, variable regions described herein may be linked to an Fc comprising one or more modification, typically to alter one or more functional properties of the antibody, such as serum half-life, complement fixation, Fc receptor binding, and/or antigen-dependent cellular cytotoxicity. Furthermore, an antibody described herein may be chemically modified (e.g., one or more chemical moieties can be attached to the antibody) or be modified to alter its glycosylation, to alter one or more functional properties of the antibody. Each of these embodiments is described in further detail below. The numbering of residues in the Fc region is that of the EU index of Kabats.

The Fc region encompasses domains derived from the constant region of an immunoglobulin, preferably a human immunoglobulin, including a fragment, analog, variant, mutant or derivative of the constant region. Suitable immunoglobulins include IgG1, IgG2, IgG3, IgG4, and other classes such as IgA, IgD. IgE and IgM. The constant region of an immunoglobulin is defined as a naturally-occurring or synthetically-produced polypeptide homologous to the immunoglobulin C-terminal region, and can include a CH1 domain, a hinge, a CH2 domain, a CH3 domain, or a CH4 domain, separately or in combination.

The constant region of an immunoglobulin is responsible for many important antibody functions including Fc receptor (FcR) binding and complement fixation. There are five major classes of heavy chain constant region, classified as IgA, IgG, 0.104, each with characteristic effector functions designated by isotype. For example, IgG is separated into four subclasses known as IgG1, IgG2, IgG3, and IgG4.

Ig molecules interact with multiple classes of cellular receptors. For example IgG molecules interact with three classes of Fcγ receptors (FcγR) specific for the IgG class of antibody, namely FcγRI, FcγRII, and FcγRIII. The important sequences for the binding of IgG to the FcγR receptors have been reported to be located in the CH2 and CH3 domains.

The serum half-life of an antibody is influenced by the ability of that antibody to bind to an Fc receptor (FcR).

In certain embodiments, the Fc region is a variant Fc region, e.g., an Fc sequence that has been modified (e.g., by amino acid substitution, deletion and/or insertion) relative to a parent Fc sequence (e.g., an unmodified Fc polypeptide that is subsequently modified to generate a variant), to provide desirable structural features and/or biological activity.

For example, one may make modifications in the Fc region in order to generate an Fc variant that (a) has increased or decreased antibody-dependent cell-mediated cytotoxicity (ADCC), (b) increased or decreased complement mediated cytotoxicity (CDC), (c) has increased or decreased affinity for C1q and/or (d) has increased or decreased affinity for a Fc receptor relative to the parent Fc. Such Fc region variants will generally comprise at least one amino acid modification in the Fc region. Combining amino acid modifications is thought to be particularly desirable. For example, the variant Fc region may include two, three, four, five, etc substitutions therein, e.g. of the specific Fc region positions identified herein.

A variant Fc region may also comprise a sequence alteration wherein amino acids involved in disulfide bond formation are removed or replaced with other amino acids. Such removal may avoid reaction with other cysteine-containing proteins present in the host cell used to produce the antibodies described herein. Even when cysteine residues are removed, single chain Fc domains can still form a dimeric Fc domain that is held together non-covalently. In other embodiments, the Fc region may be modified to make it more compatible with a selected host cell. For example, one may remove the PA sequence near the N-terminus of a typical native Fc region, which may be recognized by a digestive enzyme in *E. coli* such as proline iminopeptidase. In other embodiments, one or more glycosylation sites within the Fc domain may be removed. Residues that are typically glycosylated (e.g., asparagine) may confer cytolytic response. Such residues may be deleted or substituted with unglycosylated residues (e.g., alanine). In other embodiments, sites involved in interaction with complement, such as the C1q binding site, stay be removed from the Fc region. For example, one may delete or substitute the EKK sequence of human IgG1. In certain embodiments, sites that affect binding to Fc receptors may be removed, preferably sites other than salvage receptor binding sites. In other embodiments, an Fc region may be modified to remove an ADCC site. ADCC sites are known in the art; see, for example, Molec. Immunol. 29 (5): 633-9 (1992) with regard to ADCC sites in IgG1. Specific examples of variant Fc domains are disclosed for example, in WO 97/34631 and WO 96/32478.

In one embodiment, the hinge region of Fc is modified such that the number of cysteine residues in the hinge region is altered, e.g., increased or decreased. This approach is described further in U.S. Pat. No. 5,677,425 by Bodmer et al. The number of cysteine residues in the hinge region of Fc is altered to, for example, facilitate assembly of the light and heavy chains or to increase or decrease the stability of the antibody. In one embodiment, the Fc hinge region of an antibody is mutated to decrease the biological half-life of the antibody. More specifically, one or more amino acid mutations are introduced into the CH2-CH3 domain interface region of the Fc-hinge fragment such that the antibody has impaired Staphylococcyl protein A (SpA) binding relative to native Fc-hinge domain SpA binding. This approach is described in further detail in U.S. Pat. No. 6,165,745 by Ward et al.

In yet other embodiments, the Fc region is altered by replacing at least one amino acid residue with a different amino acid residue to alter the effector function(s) of the antibody. For example, one or more amino acids selected from amino acid residues 234, 235, 236, 237, 297, 318, 320 and 322 can be replaced with a different amino acid residue such that the antibody has an altered affinity for an effector ligand but retains the antigen-binding ability of the parent antibody. The effector ligand to which affinity is altered can be, for example, an Fc receptor or the C1 component of complement. This approach is described in further detail in U.S. Pat. Nos. 5,624,821 and 5,648,260, both by Winter et al.

In another example, one or more amino acids selected from amino acid residues 329, 331 and 322 can be replaced with a different amino acid residue such that the antibody has altered C1q binding and/or reduced or abolished complement dependent cytotoxicity (CDC). This approach is described in further detail in U.S. Pat. No. 6,194,551 by Idusogie et al.

In another example, one or more amino acid residues within amino acid positions 231 and 239 are altered to thereby alter the ability of the antibody to fix complement. This approach is described further in PCT Publication WO 94/29351 by Bodmer et al.

In yet another example, the Fc region may be modified to increase antibody dependent cellular cytotoxicity (ADCC) and/or to increase the affinity for an Fcγ receptor by modifying one or more amino acids at the following positions: 234, 235, 236, 238, 239, 240, 241, 243, 244, 245, 247, 248, 249, 252, 254, 255, 256, 258, 262, 263, 264, 265, 267, 268, 269, 270, 272, 276, 278, 280, 283, 285, 286, 289, 290, 292, 293, 294, 295, 296, 298, 299, 301, 303, 305, 307, 309, 312, 313, 315, 320, 322, 324, 325, 326, 327, 329, 330, 331, 332, 333, 334, 335, 337, 338, 340, 360, 373, 376, 378, 382, 388, 389, 398, 414, 416, 419, 430, 433, 434, 435, 436, 437, 438 or 439. Exemplary substitutions include 236A, 239D, 239E, 268D, 267E, 268E, 268F, 324T, 332D, and 332E. Exemplary variants include 239D/332E, 236A/332E, 236A/239D/332E, 268F/324T, 267E/268F, 267E/324T, and 267E/268F/324T. Other modifications for enhancing FcγR and complement interactions include but are not limited to substitutions 298A, 333A, 334A, 326A, 2471, 339D, 339Q, 280H, 290S, 298D, 298V, 243L, 292P, 300L, 396L, 3051, and 396L. These and other modifications are reviewed in Strohl, 2009, Current Opinion in Biotechnology 20:685-691.

Fc modifications that increase binding to an Fcγ receptor include amino acid modifications at any one or more of amino acid positions 238, 239, 248, 249, 252, 254, 255, 256, 258, 265, 267, 268, 269, 270, 272, 279, 280, 283, 285, 298, 289, 290, 292, 293, 294, 295, 296, 298, 301, 303, 305, 307, 312, 315, 324, 327, 329, 330, 335, 337, 3338, 340, 360, 373, 376, 379, 382, 388, 389, 398, 414, 416, 419, 430, 434, 435, 437, 438 or 439 of the Fc region, wherein the numbering of the residues in the Fc region is that of the EU index as in Kabat (WO00/42072).

Other Fc modifications that can be made to Fcs are those for reducing or ablating binding to at FcγR and/or complement proteins, thereby reducing or ablating Fc-mediated effector functions such as ADCC, ADCP, and CDC. Exemplary modifications include but are not limited substitutions, insertions, and deletions at positions 234, 235, 236, 237, 267, 269, 325, and 328, wherein numbering is according to the EU index. Exemplary substitutions include but are not limited to 234G, 235G, 236R, 237K, 267R, 269R, 325L, and 328R, wherein numbering is according to the EU index. An Fc variant may comprise 236R/328R. Other modifications for reducing FcγR and complement interactions include substitutions 297A, 234A, 235A, 237A, 318A, 228P, 236E, 268Q, 309L, 330S, 331 S, 220S, 226S, 229S, 238S, 233P, and 234V, as well as removal of the glycosylation at position 297 by mutational or enzymatic means or by production in organisms such as bacteria, that do not glycosylate proteins. These and other modifications are reviewed in Strohl, 2009, Current Opinion in Biotechnology 20:685-691.

Optionally, the Fc region may comprise a non-naturally occurring amino acid residue at additional and/or alternative positions known to one skilled in the art (see, e.g., U.S. Pat. Nos. 5,624,821; 6,277,375; 6,737,056; 6,194,551; 7,317,091; 8,101,720; PCT Patent Publications WO 00/42072; WO 01/58957; WO 02/06919; WO 04/016750; WO 04/029207; WO 04/035752; WO 04/074455; WO 04/099249; WO 04/063351; WO 05/070963; WO 05/040217, WO 05/092925 and WO 06/020114).

Fc variants that enhance affinity for an inhibitory receptor FcγRIIb may also be used. Such variants may provide an Fc fusion protein with immunomodulatory activities related to FcγRIIb+ cells, including for example B cells and monocytes. In one embodiment, the Fc variants provide selectively enhanced affinity to FcγRIIb relative to one or more activating receptors. Modifications for altering binding to FcγRIIb include one or more modifications at a position selected from the group consisting of 234, 235, 236, 237, 239, 266, 267, 268, 325, 326, 327, 328, and 332, according to the EU index. Exemplary substitutions for enhancing FcγRIIb affinity include but are not limited to 234D, 234E, 234F, 234W, 235D, 235F, 235R, 235Y, 236D, 236N, 237D, 237N, 239D, 239E, 266M, 267D, 267E, 268D, 268E, 327D, 327E, 328F, 328W, 328Y, and 332E. Exemplary substitutions include 235Y, 236D, 239D, 266M, 267E, 268D, 268E, 328F, 328W, and 328Y. Other Fc variants for enhancing binding to FcγRIIb include 235Y/267E, 2361)/267E, 2391)/2681), 2391)/267E, 267E/268D, 267E/268E, and 267E/328F.

The affinities and binding properties of an Fc region for its ligand may be determined by a variety of in vitro assay methods (biochemical or immunological based assays) known in the art including but not limited to, equilibrium methods (e.g., enzyme-linked immunoabsorbent assay (ELISA), or radioimmunoassay (RIA)), or kinetics (e.g., BIACORE analysis), and other methods such as indirect binding assays, competitive inhibition assays, fluorescence resonance energy transfer (FRET), gel electrophoresis and chromatography (e.g., gel filtration). These and other methods may utilize a label on one or more of the components being examined and/or employ a variety of detection methods including but not limited to chromogenic, fluorescent, luminescent, or isotopic labels. A detailed description of binding affinities and kinetics can be found in Paul, W. E., ed., Fundamental Immunology, 4th Ed., Lippincott-Raven, Philadelphia (1999), which focuses on antibody-immunogen interactions.

In certain embodiments, the antibody is modified to increase its biological half-life. Various approaches are possible. For example, this may be done by increasing the binding affinity of the Fc region for FcRn. For example, one or more of more of following residues can be mutated: 252, 254, 256, 433, 435, 436, as described in U.S. Pat. No. 6,277,375. Specific exemplary substitutions include one or more of the following: T252L, T254S, and/or T256F. Alternatively, to increase the biological half life, the antibody can be altered within the CH1 or CL region to contain a salvage receptor binding epitope taken from two loops of a CH2 domain of an Fc region of an IgG, as described in U.S. Pat. Nos. 5,869,046 and 6,121,022 by Presta et al. Other exemplary variants that increase binding to FcRn and/or improve pharmacokinetic properties include substitutions at positions 259, 308, 428, and 434, including for example 259f, 308F, 428L, 428M, 434S, 434H, 434F, 434Y, and 434M. Other variants that increase Fe binding to FcRn include: 250E, 250Q, 428L, 428F, 250Q/428L (Hinton et al., 2004, J. Biol. Chem. 279(8): 6213-6216, Hinton et A 2006 Journal of Immunology 176:346-356), 256A, 272A, 286A, 305A, 307A, 307Q, 311A, 312A, 376A, 378Q, 380A, 382A, 434A (Shields et al, Journal of Biological Chemistry, 2001, 276 (9):6591-6604), 252F, 252T, 252Y, 252W, 254T, 256S, 256R, 256Q, 256E, 256D, 256T, 309P, 311S, 433R, 433S, 433I, 433P, 433Q, 434H, 434F, 434Y, 252Y/254T/256E, 433K/434F/436H, 308T/309P/311S (Dail Acqua et al. Journal of Immunology, 2002, 169:5171-5180, Dall'Acqua et al. 2006, Journal of Biological Chemistry 281:23514-23524). Other modifications for modulating FcRn binding are described in Yeung et al., 2010, J Immunol, 182:7663-7671. In certain embodiments, hybrid IgG isotypes with particular biological characteristics may be used. For example, an IgG1/IgG3 hybrid variant may be constructed by substituting IgG1 positions in the CH2 and/or CH3 region with the amino acids from IgG3 at positions where the two isotypes differ. Thus a hybrid variant IgG antibody may be constructed that comprises one or more substitutions, e.g., 274Q, 276K, 300F, 339T, 356E, 358M, 384S, 392N, 397M, 422I, 435R, and 436F. In other embodiments described herein, an IgG1/IgG2 hybrid variant may be constructed by substituting IgG2 positions in the CH2 and/or CH3 region with amino acids from IgG1 at positions where the two isotypes differ. Thus a hybrid variant IgG antibody may be constructed that comprises one or more substitutions, e.g., one or more of the following amino acid substitutions: 233E, 234L, 235L, -236G (referring to an insertion of a glycine at position 236), and 327A.

Moreover, the binding sites on human IgG1 for FcγR1, FcγRII, FcγRIII and FcRn have been mapped and variants with improved binding have been described (see Shields, R. L. et al. (2001) *J. Biol. Chem.* 276:6591-6604). Specific mutations at positions 256, 290, 298, 333, 334 and 339 were shown to improve binding to FcγRIII Additionally, the following combination mutants were shown to improve FcγRIII binding: T256A/S298A, S298A/E333A, S298A/K224A and S298A/E333A/K334A, which has been shown to exhibit enhanced FcγRIIIa binding and ADCC activity (Shields et al., 2001). Other IgG1 variants with strongly enhanced binding to FcγRIIIa have been identified, including variants with S239D/I332E and S239D/I332E/A330L mutations which showed the greatest increase in affinity for FcγRIIIa, a decrease in FcγRIIb binding, and strong cytotoxic activity in cynomolgus monkeys (Lazar et al., 2006). Introduction of the triple mutations into antibodies such as alemtuzumab (CD52-specific), trastuzumab (HER2/neu-specific), rituximab (CD20-specific), and cetuximab (EGFR-specific) translated into greatly enhanced ADCC activity in vitro, and the S239D/I332E variant showed an enhanced capacity to deplete B cells in monkeys (Lazar et al., 2006). In addition, IgG1 mutants containing L235V, F243L, R292P, Y300L and P396L mutations which exhibited enhanced binding to FcγRIIIa and concomitantly enhanced ADCC activity in transgenic mice expressing human FcγRIIIa in models of B cell malignancies and breast cancer have been identified (Stavenhagen et al., 2007; Nordstrom et al., 2011). Other Fc mutants that may be used include: S298A/E333A/L334A, S239D/I332E, S239D/I332E/A330L, L235V/F243L/R292P/Y300L/P396L, and M428L/N434S.

In certain embodiments, an Fc is chosen that has reduced binding to FcγRs. An exemplary Fc, e.g., IgG1 Fc, with reduced FcγR binding comprises the following three amino acid substitutions: L234A, L235E and G237A.

In certain embodiments, an Fc is chosen that has reduced complement fixation. An exemplary Fc, e.g., IgG1 Fc, with reduced complement fixation has the following two amino acid substitutions: A330S and P331S.

In certain embodiments, an Fc is chosen that has essentially no effector function, i.e., it has reduced binding to FcγRs and reduced complement fixation. An exemplary Fc, e.g., IgG1 Fc, that is effectorless comprises the following five mutations: L234A, L235E, G237A, A330S and P331S. Exemplary heavy chains comprising these mutations are set forth in Table 15.

When using an IgG4 constant domain, it is usually preferable to include the substitution S228P, which mimics the hinge sequence in IgG1 and thereby stabilizes IgG4 molecules.

In still another embodiment, the glycosylation of an antibody is modified. For example, an aglycoslated antibody can be made (i.e., the antibody lacks glycosylation). Glycosylation can be altered to, for example, increase the affinity of the antibody for antigen. Such carbohydrate modifications can be accomplished by, for example, altering one or more sites of glycosylation within the antibody sequence. For example, one or more amino acid substitutions can be made that result in elimination of one or more variable region framework glycosylation sites to thereby eliminate glycosylation at that site. Such aglycosylation may increase the affinity of the antibody for antigen. Such an approach is described in further detail in U.S. Pat. Nos. 5,714,350 and 6,350,861 by Co et al.

Glycosylation of the constant region on N297 may be prevented by mutating the N297 residue to another residue, e.g., N297A, and/or by mutating an adjacent amino acid, e.g., 298 to thereby reduce glycosylation on N297.

Additionally or alternatively, an antibody can be made that has an altered type of glycosylation, such as a hypofucosylated antibody having reduced amounts of fucosyl residues or an antibody having increased bisecting GlcNac structures. Such altered glycosylation patterns have been demonstrated to increase the ADCC ability of antibodies. Such carbohydrate modifications can be accomplished by, for example, expressing the antibody in a host cell with altered glycosylation machinery. Cells with altered glycosylation machinery have been described in the art and can be used as host cells in which to express recombinant antibodies described herein to thereby produce an antibody with altered glycosylation. For example, EP 1,176,195 by Hanai et al. describes a cell line with a functionally disrupted FUT8 gene, which encodes a fucosyl transferase, such that antibodies expressed in such a cell line exhibit hypofucosylation. PCT Publication WO 03/035835 by Presta describes a variant CHO cell line, Lec13 cells, with reduced ability to attach fucose to Asn(297)-linked carbohydrates, also resulting in hypofucosylation of antibodies expressed in that host cell (see also Shields, R. L. et al. (2002) *J. Biol. Chem.* 277:26733-26740). PCT Publication WO 99/54342 by Umana et al. describes cell lines engineered to express glycoprotein-modifying glycosyl transferases (e.g., beta(1, 4)-N-acetylglucosaminyltransferase III (GnTIII)) such that antibodies expressed in the engineered cell lines exhibit increased bisecting GlcNac structures which results in increased ADCC activity of the antibodies (see also Umana et al. (1999) *Nat. Biotech.* 17:176-180).

Another modification of the antibodies described herein is pegylation. An antibody can be pegylated to, for example, increase the biological (e.g., serum) half-life of the antibody. To pegylate an antibody, the antibody, or fragment thereof, typically is reacted with polyethylene glycol (PEG), such as a reactive ester or aldehyde derivative of PEG, under conditions in which one or more PEG groups become attached to the antibody or antibody fragment. Preferably, the pegylation is carried out via an acylation reaction or an alkylation reaction with a reactive PEG molecule (or an analogous reactive water-soluble polymer). As used herein, the term "polyethylene glycol" is intended to encompass any of the forms of PEG that have been used to derivatize other proteins, such as mono (C1-C10) alkoxy- or aryloxy-polyethylene glycol or polyethylene glycol-maleimide. In certain embodiments, the antibody to be pegylated is an aglycosylated antibody. Methods for pegylating proteins are known in the art and can be applied to the antibodies described herein. See for example, EP 0 154 316 by Nishimura et al. and EP 0 401 384 by Ishikawa et al.

VIII. Antibody Physical Properties

Antibodies described herein can contain one or more glycosylation sites in either the light or heavy chain variable region. Such glycosylation sites may result in increased immunogenicity of the antibody or an alteration of the pK of the antibody due to altered antigen binding (Marshall et al (1972) *Annu Rev Biochem* 41:673-702; Gala and Morrison (2004) *J. Immunol* 172:5489-94; Wallick et al (1988) *J Exp Med* 168:1099-109; Spiro (2002) *Glycobiology* 12:43R-56R; Parekh et al (1985) *Nature* 316:452-7; Mimura et al. (2000) *Mol Immunol* 37:697-706). Glycosylation has been known to occur at motifs containing an N-X-S/T sequence. In some instances, it is preferred to have an anti-GITR antibody that does not contain variable region glycosylation. This can be achieved either by selecting antibodies that do not contain the glycosylation motif in the variable region or by mutating residues within the glycosylation region.

In certain embodiments, the antibodies described herein do not contain asparagine isomerism sites. The deamidation of asparagine may occur on N-G or D-G sequences and result in the creation of an isoaspartic acid residue that introduces a kink into the polypeptide chain and decreases its stability (isoaspartic acid effect).

Each antibody will have a unique isoelectric point (pI), which generally falls in the pH range between 6 and 9.5. The pI for an IgG1 antibody typically falls within the pH range of 7-9.5 and the pI for an IgG4 antibody typically falls within the pH range of 6-8. There is speculation that antibodies with a pI outside the normal range may have some unfolding and instability under in vivo conditions. Thus, it is preferred to have an anti-GITR antibody that contains a pI value that falls in the normal range. This can be achieved either by selecting antibodies with a pI in the normal range or by mutating charged surface residues.

Each antibody will have a characteristic melting temperature, with a higher melting temperature indicating greater overall stability in vivo (Krishnamurthy R and Manning M C (2002) *Curr Pharm Biotechnol* 3:361-71). Generally, it is preferred that the $T_{M1}$ (the temperature of initial unfolding) be greater than 60° C., preferably greater than 65° C., even more preferably greater than 70° C. The melting point of an antibody can be measured using differential scanning calorimetry (Chen et al (2003) *Pharm Res* 20:1952-60; Ghirlando et al (1999) *Immunol Lett* 68:47-52) or circular dichroism (Murray et al. (2002) *J. Chromatogr Sci* 40:343-9). In a preferred embodiment, antibodies are selected that do not degrade rapidly. Degradation of an antibody can be measured using capillary electrophoresis (CE) and MALDI-MS (Alexander A J and Hughes D E (1995) *Anal Chem* 67:3626-32).

In another preferred embodiment, antibodies are selected that have minimal aggregation effects, which can lead to the triggering of an unwanted immune response and/or altered or unfavorable pharmacokinetic properties. Generally, antibodies are acceptable with aggregation of 25% or less, preferably 20% or less, even more preferably 15% or less, even more preferably 10% or less and even more preferably 5% or less. Aggregation can be measured by several techniques, including size-exclusion column (SEC), high performance liquid chromatography (HPLC), and light scattering.

IX. Methods of Engineering Antibodies

As discussed above, the anti-GITR antibodies having $V_H$ and $V_L$ sequences disclosed herein can be used to create new anti-GITR antibodies by modifying the VH and/or VL sequences, or the constant region(s) attached thereto. Thus, in another aspect described herein, the structural features of an anti-GITR antibody described herein, e.g. 28F3, 19D3, 18E10, 3C3, 2G6, 8A6, 9G7, 14E3, 19H8, and 6G10 are used to create structurally related anti-GITR antibodies that retain at least one functional property of the antibodies described herein, such as binding to human GITR and cynomolgus GITR. For example, one or more CDR regions of 28F3, 19D3, 18E10, 3C3, 2G6, 8A6, 9G7, 14E3, 19H8, and 6G10, or mutations thereof, can be combined recombinantly with known framework regions and/or other CDRs to create additional, recombinantly-engineered, anti-GITR antibodies described herein, as discussed above. Other types of modifications include those described in the previous section. The starting material for the engineering method is one or more of the $V_H$ and/or $V_L$ sequences provided herein, or one or more CDR regions thereof. To create the engineered antibody, it is not necessary to actually prepare (i.e., express as a protein) an antibody having one or more of the $V_H$ and/or $V_L$ sequences provided herein, or one or more CDR regions thereof. Rather, the information contained in the sequence(s) is used as the starting material to create a "second generation" sequence(s) derived from the original sequence(s) and then the "second generation" sequence(s) is prepared and expressed as a protein.

Accordingly, provided herein are methods for preparing an anti-GITR antibody comprising:

(a) providing: (i) a heavy chain variable region antibody sequence comprising a CDR1 sequence selected from the group consisting of SEQ ID NOs: 20, 33, 46, 62, 78, 91, 106, 122, 138, and 342, a CDR2 sequence selected from the group consisting of SEQ ID NOs: 21, 34, 47, 63, 79, 92, 107, 123, 139, and 343, and/or a CDR3 sequence selected from the group consisting of SEQ ID NOs: 22, 35, 48, 64, 80, 93, 108, 124, 140, and 344; and (ii) a light chain variable region antibody sequence comprising a CDR1 sequence selected from the group consisting of SEQ ID NOs: 23, 36, 49, 65, 68, 81, 94, 109, 112, 125, 141, 144, and 345, a CDR2 sequence selected from the group consisting of SEQ ID NOs: 24, 37, 50, 66, 69, 82, 95, 110, 113, 126, 142, 145, and 346, and/or a CDR3 sequence selected from the group consisting of SEQ ID NOs: 25, 38, 51, 67, 70, 83, 96, 111, 114, 127, 143, 146, and 347;

(b) altering at least one amino acid residue within the heavy chain variable region antibody sequence and/or the light chain variable region antibody sequence to create at least one altered antibody sequence; and (c) expressing the altered antibody sequence as a protein.

Standard molecular biology techniques can be used to prepare and express the altered antibody sequence.

Preferably, the antibody encoded by the altered antibody sequence(s) is one that retains one, some or all of the functional properties of the anti-GITR antibodies described herein, which include, (1) binding to soluble human GITR, e.g., with a $K_D$ of 10 nM or less (e.g., 0.01 nM to 10 nM), e.g., as measured by Biacore;
(2) binding to membrane bound human GITR, e.g., with a $K_D$ of 1 nM or less (e.g., 0.01 nM to 1 nM), e.g., as measured by Scatchard;
(3) binding to membrane bound human GITR, e.g., with an $EC_{50}$ of 1 nM or less (e.g., 0.01 nM to 1 nM), e.g., as measured by FACS;
(4) binding to cynomolgus GITR, e.g., bind to membrane bound cynomolgus GITR, e.g., with an $EC_{50}$ of 10 nM or less (e.g., 0.01 nM to 10 nM), e.g., as measured by FACS;
(5) inducing or enhancing T cell activation, such as in the presence of CD3 engagement (e.g., in the presence of suboptimal anti-CD3 concentrations), as evidenced, by (i) increased IL-2 and/or IFN-γ production in GITR-expressing T cells and/or (ii) enhanced T cell proliferation;
(6) inducing or enhancing T cell activation without requiring multivalent cross-linking;
(7) inhibiting the binding of GITR ligand to GITR on 3A9-hGITR cells, e.g., with an $EC_{50}$ of 1 μg/mL or less as measured by FACS;
(8) at most partially inhibiting the binding of GITR ligand to GITR on activated T cells;
(9) binding to a conformational epitope on mature human GITR (SEQ ID NO: 4), e.g., a discontinuous epitope within the amino acid sequences

```
                            (SEQ ID NO: 217)
PTGGPGCGPGRLLLGTGT
and
                            (SEQ ID NO: 218)
CRDYPGEE;
```

(10) binding to both O-linked and N-linked glycosylated and unglycosylated human GITR;
(11) having agonist activity in the absence of binding to an Fc receptor, but wherein binding to an Fc receptor further enhances the agonist activity; and
(12) competing in either direction or both directions for binding to human GITR with 28F3, 3C3-1, 3C3-2, 2G6, 8A6, 9G7-1, 9G7-2, 14E3, 19H8-1, 19H8-2, 19D3, 18E10, and/or 6G10.

The altered antibody may exhibit one or more, two or more, three or more, four or more, five or more, six or more, seven or more, eight or more, nine or more, ten or more, eleven, or all of the functional properties set forth as (1) through (12) above. The functional properties of the altered antibodies can be assessed using standard assays available in the art and/or described herein, such as those set forth in the Examples (e.g., ELISAs, FACS).

In certain embodiments of the methods of engineering antibodies described herein, mutations can be introduced randomly or selectively along all or part of an anti-GITR antibody coding sequence and the resulting modified anti-GITR antibodies can be screened for binding activity and/or other functional properties as described herein. Mutational methods have been described in the art. For example, PCT Publication WO 02/092780 by Short describes methods for creating and screening antibody mutations using saturation mutagenesis, synthetic ligation assembly, or a combination thereof. Alternatively, PCT Publication WO 03/074679 by Lazar et al. describes methods of using computational screening methods to optimize physiochemical properties of antibodies.

X. Nucleic Acid Molecules

Another aspect described herein pertains to nucleic acid molecules that encode the antibodies described herein. The nucleic acids may be present in whole cells, in a cell lysate, or in a partially purified or substantially pure form. A nucleic acid is "isolated" or "rendered substantially pure" when purified away from other cellular components or other contaminants, e.g., other cellular nucleic acids (e.g., other chromosomal DNA, e.g., the chromosomal DNA that is linked to the isolated DNA in nature) or proteins, by standard techniques, including alkaline/SDS treatment, CsCl banding, column chromatography, restriction enzymes, agarose gel electrophoresis and others well known in the art. See, F. Ausubel, et al., ed. (1987) Current Protocols in Molecular Biology, Greene Publishing and Wiley Interscience, New York. A nucleic acid described herein can be, for example, DNA or RNA and may or may not contain intronic sequences. In a certain embodiments, the nucleic acid is a cDNA molecule.

Nucleic acids described herein can be obtained using standard molecular biology techniques. For antibodies expressed by hybridomas (e.g., hybridomas prepared from transgenic mice carrying human immunoglobulin genes as described further below), cDNAs encoding the light and heavy chains of the antibody made by the hybridoma can be obtained by standard PCR amplification or cDNA cloning techniques. For antibodies obtained from an immunoglobulin gene library (e.g., using phage display techniques), nucleic acid encoding the antibody can be recovered from the library.

Preferred nucleic acids molecules described herein are those encoding the VH and VL sequences of the 28F3, 19D3, 18E10, 3C3-1, 3C3-2, 2G6, 8A6, 9G7-1, 9G7-2, 14E3, 19H8-1, 19H8-2, and 6G10 monoclonal antibodies. Exemplary DNA sequences encoding the VH sequences of 28F3, 19D3, 18E10, 3C3, 2G6, 8A6, 9G7, 14E3, 19H8, and 6G10 are set forth in SEQ ID NOs: 147, 154, 158, 162, 168, 172, 176, 182, 186, and 353, respectively. Exemplary DNA sequences encoding the VL sequences of 28F3, 19D3, 18E10, 3C3-1, 3C3-2, 2G6, 8A6, 9G7-1, 9G7-2, 14E3, 19H8-1, 19H8-2, and 6G10 are set forth in SEQ ID NOs: 148, 155, 163, 164, 169, 173, 177, 178, 183, 187, 188, and 354, respectively. Exemplary DNA sequences encoding the heavy chain sequences of 28F3, 19D3, 18E10, 3C3 (3C3-1 and 3C3-2), 2G6, 8A6, 9G7 (9G7-1 and 9G7-2), 14E3, 19H8 (19H8-1 and 19H8-2), and 6G10 are set forth in SEQ ID NOs: 149, 156, 160, 165, 170, 174, 179, 184, 189, and 355, respectively. Exemplary DNA sequences encoding the light chain sequences of 28F3, 19D3, 18E10, 3C3-1, 3C3-2, 2G6, 8A6, 9G7-1, 9G7-2, 14E3, 19H8-1, 19H8-2, and 6G10 are set forth in SEQ ID NOs: 150, 157, 161, 166, 167, 171, 175, 181, 180, 185, 190, 191, and 356, respectively.

Exemplary nucleic acids encoding the mature VH and VL domains of 28F3.IgG1 and 28F3.IgG1.1 (same variable region) antibodies are set forth as SEQ ID NOs: 147 and 148, respectively. Exemplary nucleic acids encoding the mature heavy chains of 28F3.IgG1 and 28F3.IgG1.1 antibodies are set forth as SEQ ID NOs: 151 and 152, respectively, and an exemplary nucleic acid encoding the mature light chain of 28F3.IgG1 and 28F3.IgG1.1 antibodies is set forth as SEQ ID NO: 153.

Exemplary VH and VL domains of 28F3.IgG1 and 28F3.IgG1.1 (same variable region) antibodies with a signal peptide are set forth as SEQ ID NOs: 357 and 358, respectively, and the nucleotide sequences encoding these are set forth as SEQ ID NOs: 359 and 360, respectively.

Exemplary heavy chains of 28F3.IgG1 and 28F3.IgG1.1 antibodies with a signal peptide are set forth as SEQ ID NOs: 361 and 362, respectively, and exemplary nucleotide sequences encoding these are set forth as SEQ ID NOs: 363 and 364, respectively. An exemplary light chain of 28F3.IgG1 and 28F3.IgG1.1 antibodies with a signal peptide is set forth as SEQ ID NO: 365, and an exemplary nucleotide sequence encoding it is set forth as SEQ ID NOs: 366.

A method for making 28F3.IgG1 may comprise expressing the heavy chain and the light chains in a cell line comprising the nucleotide sequences encoding the heavy and light chains with a signal peptide, e.g., SEQ ID NO: 363 and 365, respectively. A method for making 28F3.IgG1.1 may comprise expressing the heavy chain and the light chains in a cell line comprising the nucleotide sequences encoding the heavy and light chains with a signal peptide, e.g., SEQ ID NO: 364 and 366, respectively. Host cells comprising these nucleotide sequences are encompassed herein.

Once DNA fragments encoding VH and VL segments are obtained, these DNA fragments can be further manipulated by standard recombinant DNA techniques, for example to convert the variable region genes to full-length antibody chain genes, to Fab fragment genes or to a scFv gene. In these manipulations, a VL- or VH-encoding DNA fragment is operatively linked to another DNA fragment encoding another protein, such as an antibody constant region or a flexible linker. The term "operatively linked", as used in this context, is intended to mean that the two DNA fragments are joined such that the amino acid sequences encoded by the two DNA fragments remain in-frame.

The isolated DNA encoding the VH region can be converted to a full-length heavy chain gene by operatively linking the VH-encoding DNA to another DNA molecule encoding heavy chain constant regions (hinge, CH1, CH2 and/or CH3). The sequences of human heavy chain constant region genes are known in the art (see e.g., Kabat, E. A., et al. (1991) Sequences of Proteins of Immunological Interest, Fifth Edition, U.S. Department of Health and Human Services, NIH Publication No. 91-3242) and DNA fragments encompassing these regions can be obtained by standard PCR amplification. The heavy chain constant region can be an IgG1, IgG2, IgG3, IgG4, IgA, IgE, IgM or IgD constant region, for example, an IgG1 region. For a Fab fragment heavy chain gene, the VH-encoding DNA can be operatively linked to another DNA molecule encoding only the heavy chain CH1 constant region.

The isolated DNA encoding the VL region can be converted to a full-length light chain gene (as well as a Fab light chain gene) by operatively linking the VL-encoding DNA to another DNA molecule encoding the light chain constant region, CL. The sequences of human light chain constant region genes are known in the art (see e.g., Kabat, E. A., et al. (1991) Sequences of Proteins of Immunological Interest, Fifth Edition, U.S. Department of Health and Human Services, NIH Publication No. 91-3242) and DNA fragments encompassing these regions can be obtained by standard PCR amplification. The light chain constant region can be a kappa or lambda constant region.

To create a scFv gene, the VH- and VL-encoding DNA fragments are operatively linked to another fragment encoding a flexible linker, e.g., encoding the amino acid sequence $(Gly_4\text{-}Ser)_3$, such that the VH and VL sequences can be expressed as a contiguous single-chain protein, with the VL and VH regions joined by the flexible linker (see e.g., Bird et al. (1988) Science 242:423-426; Huston et al. (1988) Proc. Natl. Acad. Sci. USA 85:5879-5883; McCafferty et al., (1990) Nature 348:552-554).

Also provided herein are nucleic acid molecules encoding VH and VL sequences that are homologous to those of the 28F3, 19D3, 18E10, 3C3-1, 3C3-2, 2G6, 8A6, 9G7-1, 9G7-2, 14E3, 19H8-1, 19H8-2, and 6G10 monoclonal antibodies. Exemplary nucleic acid molecules encode VH and VL sequences that are at least 70% identical, for example, at least 75%, at least 80%, at least 85%, at least 90%, at least 95%, or at least 99% identical, to nucleic acid molecules encoding the VH and VL sequences of the 28F3, 19D3, 18E10, 3C3-1, 3C3-2, 2G6, 8A6, 9G7-1, 9G7-2, 14E3, 19H8-1, 19H8-2, and 6G10 monoclonal antibodies. Also provided herein are nucleic acid molecules with conservative substitutions (i.e., substitutions that do not alter the resulting amino acid sequence upon translation of nucleic acid molecule), e.g., for codon optimization.

XI. Antibody Production

Monoclonal antibodies described herein can be produced using a variety of known techniques, such as the standard somatic cell hybridization technique described by Kohler and Milstein, Nature 256: 495 (1975). Although somatic cell hybridization procedures are preferred, in principle, other techniques for producing monoclonal antibodies also can be employed, e.g., viral or oncogenic transformation of B lymphocytes, phage display technique using libraries of human antibody genes.

The preferred animal system for preparing hybridomas is the murine system. Hybridoma production in the mouse is a very well-established procedure. Immunization protocols and techniques for isolation of immunized splenocytes for fusion are known in the art. Fusion partners (e.g., murine myeloma cells) and fusion procedures are also known.

Chimeric or humanized antibodies described herein can be prepared based on the sequence of a murine monoclonal antibody prepared as described above. DNA encoding the heavy and light chain immunoglobulins can be obtained from the murine hybridoma of interest and engineered to contain non-murine (e.g., human) immunoglobulin sequences using standard molecular biology techniques. For example, to create a chimeric antibody, the murine variable regions can be linked to human constant regions using methods known in the art (see e.g., U.S. Pat. No. 4,816,567 to Cabilly et al.). To create a humanized antibody, the murine CDR regions can be inserted into a human framework using methods known in the art (see e.g., U.S. Pat. No. 5,225,539 to Winter, and U.S. Pat. Nos. 5,530,101; 5,585,089; 5,693, 762 and 6,180,370 to Queen et al.).

In one embodiment, the antibodies described herein are human monoclonal antibodies. Such human monoclonal antibodies directed against GITR can be generated using transgenic or transchromosomic mice carrying parts of the human immune system rather than the mouse system. These transgenic and transchromosomic mice include mice referred to herein as HuMAb mice and KM mice, respectively, and are collectively referred to herein as "human Ig mice."

The HuMAb Mouse® (Medarex, Inc.) contains human immunoglobulin gene miniloci that encode unrearranged human heavy (μ and γ) and κ light chain immunoglobulin sequences, together with targeted mutations that inactivate the endogenous μ and κ chain loci (see e.g., Lonberg, et al. (1994) Nature 368(6474): 856-859). Accordingly, the mice exhibit reduced expression of mouse IgM or κ, and in response to immunization, the introduced human heavy and light chain transgenes undergo class switching and somatic mutation to generate high affinity human IgGκ monoclonal (Lonberg, N. et al. (1994), supra; reviewed in Lonberg, N. (1994) *Handbook of Experimental Pharmacology* 113:49-101; Lonberg, N. and Huszar, D. (1995) *Intern. Rev. Immunol.* 13: 65-93, and Harding, F. and Lonberg, N. (1995) *Ann. N.Y. Acad. Sci.* 764:536-546). The preparation and use of HuMab mice, and the genomic modifications carried by such mice, is further described in Taylor, L. et al. (1992) *Nucleic Acids Research* 20:6287-6295; Chen, J. et al. (1993) *International Immunology* 5: 647-656; Tuaillon et al. (1993) *Proc. Natl. Acad. Sci. USA* 90:3720-3724; Choi et al. (1993) *Nature Genetics* 4:117-123; Chen, J. et al. (1993) *EMBO J.* 12: 821-830; Tuaillon et al. (1994) *J. Immunol.* 152:2912-2920; Taylor, L. et al. (1994) *International Immunology* 6: 579-591; and Fishwild, D. et al. (1996) *Nature Biotechnology* 14: 845-851, the contents of all of which are hereby specifically incorporated by reference in their entirety. See further, U.S. Pat. Nos. 5,545,806; 5,569,825; 5,625,126; 5,633,425; 5,789,650; 5,877,397; 5,661,016; 5,814,318; 5,874,299; and 5,770,429; all to Lonberg and Kay; U.S. Pat. No. 5,545,807 to Surani et al.; PCT Publication Nos. WO 92/03918, WO 93/12227, WO 94/25585, WO 97/13852, WO 98/24884 and WO 99/45962, all to Lonberg and Kay; and PCT Publication No. WO 01/14424 to Korman et al.

In certain embodiments, antibodies described herein are raised using a mouse that carries human immunoglobulin sequences on transgenes and transchomosomes, such as a mouse that carries a human heavy chain transgene and a human light chain transchromosome. Such mice, referred to herein as "KM mice", are described in detail in PCT Publication WO 02/43478 to Ishida et al.

Still further, alternative transgenic animal systems expressing human immunoglobulin genes are available in the art and can be used to raise anti-GITR antibodies described herein. For example, an alternative transgenic system referred to as the Xenomouse (Abgenix, Inc.) can be used; such mice are described in, for example, U.S. Pat. Nos. 5,939,598; 6,075,181; 6,114,598; 6, 150,584 and 6,162,963 to Kucherlapati et al.

Moreover, alternative transchromosomic animal systems expressing human immunoglobulin genes are available in the art and can be used to raise anti-GITR antibodies described herein. For example, mice carrying both a human heavy chain transchromosome and a human light chain tranchromosome, referred to as "TC mice" can be used; such mice are described in Tomizuka et al. (2000) *Proc. Natl. Acad. Sci. USA* 97:722-727. Furthermore, cows carrying human heavy and light chain transchromosomes have been described in the art (Kuroiwa et al. (2002) *Nature Biotechnology* 20:889-894) and can be used to raise anti-GITR antibodies described herein.

Additional mouse systems described in the art for raising human antibodies, e.g., human anti-GITR antibodies, include (i) the VeloclImmune® mouse (Regeneron Pharmaceuticals, Inc.), in which the endogenous mouse heavy and light chain variable regions have been replaced, via homologous recombination, with human heavy and light chain variable regions, operatively linked to the endogenous mouse constant regions, such that chimeric antibodies (human V/mouse C) are raised in the mice, and then subsequently converted to fully human antibodies using standard recombinant DNA techniques; and (ii) the MeMo® mouse (Merus Biopharmaceuticals, Inc.), in which the mouse contains unrearranged human heavy chain variable regions but a single rearranged human common light chain variable region. Such mice, and use thereof to raise antibodies, are described in, for example, WO 2009/15777, US 2010/0069614, WO 2011/072204, WO 2011/097603, WO 2011/163311, WO 2011/163314, WO 2012/148873, US 2012/0070861 and US 2012/0073004.

Human monoclonal antibodies described herein can also be prepared using phage display methods for screening libraries of human immunoglobulin genes. Such phage display methods for isolating human antibodies are established in the art. See for example: U.S. Pat. Nos. 5,223,409; 5,403,484; and 5,571,698 to Ladner et al.; U.S. Pat. Nos. 5,427,908 and 5,580,717 to Dower et al.; U.S. Pat. Nos. 5,969,108 and 6,172,197 to McCafferty et al.; and U.S. Pat. Nos. 5,885,793; 6,521,404; 6,544,731; 6,555,313; 6,582,915 and 6,593,081 to Griffiths et al.

Human monoclonal antibodies described herein can also be prepared using SCID mice into which human immune cells have been reconstituted such that a human antibody response can be generated upon immunization. Such mice are described in, for example, U.S. Pat. Nos. 5,476,996 and 5,698,767 to Wilson et al.

Immunizations

To generate fully human antibodies to GITR, transgenic or transchromosomal mice containing human immunoglobulin genes (e.g., HCo12, HCo7 or KM mice) can be immunized with a purified or enriched preparation of the GITR antigen and/or cells expressing GITR or fragment thereof, as described for other antigens, for example, by Lonberg et al. (1994) *Nature* 368(6474): 856-859; Fishwild et al. (1996) *Nature Biotechnology* 14: 845-851 and WO 98/24884. Alternatively, mice can be immunized with DNA encoding human GITR or fragment thereof. Preferably, the mice will be 6-16 weeks of age upon the first infusion. For example, a purified or enriched preparation (5-50 μg) of the recombinant GITR antigen can be used to immunize the HuMAb mice intraperitoneally. In the event that immunizations using a purified or enriched preparation of the GITR antigen do not result in antibodies, mice can also be immunized with cells expressing GITR, e.g., a cell line, to promote immune responses. Exemplary cell lines include GITR-overexpressing stable CHO and Raji cell lines.

Cumulative experience with various antigens has shown that the HuMAb transgenic mice respond best when initially immunized intraperitoneally (IP) or subcutaneously (SC) with antigen in Ribi's adjuvant, followed by every other week IP/SC immunizations (up to a total of 10) with antigen in Ribi's adjuvant. The immune response can be monitored over the course of the immunization protocol with plasma samples being obtained by retroorbital bleeds. The plasma can be screened by ELISA and FACS (as described below), and mice with sufficient titers of anti-GITR human immunoglobulin can be used for fusions. Mice can be boosted intravenously with antigen 3 days before sacrifice and removal of the spleen and lymph nodes. It is expected that 2-3 fusions for each immunization may need to be performed. Between 6 and 24 mice are typically immunized for each antigen. Usually, HCo7, HCo12, and KM strains are used. In addition, both HCo7 and HCo12 transgene can be bred together into a single mouse having two different human heavy chain transgenes (HCo7/HCo12).

Generation of Hybridomas Producing Monoclonal Antibodies to GITR

To generate hybridomas producing human monoclonal antibodies described herein, splenocytes and/or lymph node cells from immunized mice can be isolated and fused to an appropriate immortalized cell line, such as a mouse myeloma cell line. The resulting hybridomas can be screened for the production of antigen-specific antibodies. For example, single cell suspensions of splenic lymphocytes from immunized mice can be fused to Sp2/0 nonsecreting mouse myeloma cells (ATCC, CRL 1581) with 50% PEG. Cells are plated at approximately $2 \times 10^5$ in flat bottom microtiter plate, followed by a two week incubation in selective medium containing 10% fetal Clone Serum, 18% "653" conditioned media, 5% origen (IGEN), 4 mM L-glutamine, 1 mM sodium pyruvate, 5 mM HEPES, 0.055 mM 2-mercaptoethanol, 50 units/ml penicillin, 50 mg/ml streptomycin, 50 mg/ml gentamycin and 1×HAT (Sigma). After approximately two weeks, cells can be cultured in medium in which the HAT is replaced with HT. Individual wells can then be screened by ELISA for human monoclonal IgM and IgG antibodies. Once extensive hybridoma growth occurs, medium can be observed usually after 10-14 days. The antibody secreting hybridomas can be replated, screened again, and if still positive for human IgG, the monoclonal antibodies can be subcloned at least twice by limiting dilution. The stable subclones can then be cultured in vitro to generate small amounts of antibody in tissue culture medium for characterization.

To purify human monoclonal antibodies, selected hybridomas can be grown in two-liter spinner-flasks for monoclonal antibody purification. Supernatants can be filtered and concentrated before affinity chromatography with protein A-sepharose (Pharmacia, Piscataway, N.J.). Eluted IgG can be checked by gel electrophoresis and high performance liquid chromatography to ensure purity. The buffer solution can be exchanged into PBS, and the concentration can be determined by OD280 using 1.43 extinction coefficient. The monoclonal antibodies can be aliquoted and stored at −80° C.

Generation of Transfectomas Producing Monoclonal Antibodies to GITR

Antibodies can be produced in a host cell transfectoma using, for example, a combination of recombinant DNA techniques and gene transfection methods as is well known in the art (Morrison, S. (1985) Science 229:1202).

For example, to express antibodies, or antibody fragments thereof, DNAs encoding partial or full-length light and heavy chains, can be obtained by standard molecular biology techniques (e.g., PCR amplification or cDNA cloning using a hybridoma that expresses the antibody of interest) and the DNAs can be inserted into expression vectors such that the genes are operatively linked to transcriptional and translational control sequences. In this context, the term "operatively linked" is intended to mean that an antibody gene is ligated into a vector such that transcriptional and translational control sequences within the vector serve their intended function of regulating the transcription and translation of the antibody gene. The expression vector and expression control sequences are chosen to be compatible with the expression host cell used. The antibody light chain gene and the antibody heavy chain gene can be inserted into separate vector or both genes are inserted into the same expression vector. The antibody genes are inserted into the expression vector(s) by standard methods (e.g., ligation of complementary restriction sites on the antibody gene fragment and vector, or blunt end ligation if no restriction sites are present). The light and heavy chain variable regions of the antibodies described herein can be used to create full-length antibody genes of any antibody isotype by inserting them into expression vectors already encoding heavy chain constant and light chain constant regions of the desired isotype such that the $V_H$ segment is operatively linked to the $C_H$ segment(s) within the vector and the $V_L$ segment is operatively linked to the $C_L$ segment within the vector.

Additionally or alternatively, the recombinant expression vector can encode a signal peptide that facilitates secretion of the antibody chain from a host cell. The antibody chain gene can be cloned into the vector such that the signal peptide is linked in-frame to the amino terminus of the antibody chain gene. The signal peptide can be an immunoglobulin signal peptide or a heterologous signal peptide (i.e., a signal peptide from a non-immunoglobulin protein).

In exemplary embodiments, the following signal peptides from human antibody heavy and light chains may be used: MEFGLSWVFLVALLRGVQC (SEQ ID NO: 315); MKHLWFFLLLLVAAPRWVLS (SEQ ID NO: 321); MEFGLNWVFLVALLRGVQC (SEQ ID NO: 327); MEFGLSWIFLAAILKGVQC (SEQ ID NO: 329); MKHLWFFLLLLVAAPRWVLS (SEQ ID NO: 333); MDMRVLAQLLGLLLLCFPGARC (SEQ ID NO: 323); MEAPAQLLFLLLLWLPDTTG (SEQ ID NO: 325); MDMRVPAQLLGLLLLWLPGARC (SEQ ID NO: 317); MRVLAQLLGLLLLCFPGARC (SEQ ID NO: 319); and METPAQLLFLLLLWLPDTTG (SEQ ID NO: 331).

Heavy and light chains of anti-GITR antibodies can be expressed with the respective signal sequence that was linked to each chain in the hybridoma from which they were cloned. Below are the signal sequences of various anti-GITR antibodies as present in the hybridoma from which they were cloned, which signal sequences can be used to express the same antibody or another antibody:

```
28F3 VH signal sequence:
                                    (SEQ ID NO: 315)
MEFGLSWVFLVALLRGVQC (SEQ ID NO: 316)
ATGGAGTTTGGGCTGAGCTGGGTTTTCCTCGTTGCTCTTTTAAGAGGTGT

CCAGTGT

28F3 VL signal sequence:
                                    (SEQ ID NO: 317)
MDMRVPAQLLGLLLLWLPGARC (SEQ ID NO: 318)
ATGGACATGAGGGTCCCCGCTCAGCTCCTGGGGCTTCTGCTGCTCTGGCT

CCCAGGTGCCAGAT

18E10 VH signal sequence:
                                    (SEQ ID NO: 315)
MEFGLSWVFLVALLRGVQC (SEQ ID NO: 316)
ATGGAGTTTGGGCTGAGCTGGGTTTTCCTCGTTGCTCTTTTAAGAGGTGT

CCAGTGT

18H10 VL signal sequence:
                                    (SEQ ID NO: 317)
MDMRVLAQLLGLLLLCFPGARC (SEQ ID NO: 318)
ATGGACATGAGGGTCCTCGCTCAGCTCCTGGGGCTCCTGCTGCTCTGTTT

CCCAGGTGCCAGAT
```

19D3 VH signal sequence:
(SEQ ID NO: 315)
MEFGLSWVFLVALLRGVQC (SEQ ID NO: 316)
ATGGAGTTTGGGCTGAGCTGGGTTTTCCTCGTTGCTCTTTTAAGAGGTGT
CCAGTGT 19D3 VL signal sequence:
(SEQ ID NO: 319)
MRVLAQLLGLLLLCFPGARC (SEQ ID NO: 320)
ATGAGGGTCCTCGCTCAGCTCCTGGGGCTCCTGCTGCTCTGTTTCCCAGG
TGCCAGATGT 3C3 VH signal sequence:
(SEQ ID NO: 321)
MKHLWFFLLLVAAPRWVLS (SEQ ID NO: 322)
ATGAAACACCTGTGGTTCTTCCTCCTCCTGGTGGCAGCTCCCAGATGGGT
CCTGTCC 3C3 VL1 signal sequence:
(SEQ ID NO: 323)
MDMRVLAQLLGLLLLCFPGARC (SEQ ID NO: 324)
ATGGACATGAGGGTCCTCGCTCAGCTCCTGGGGCTCCTGCTGCTCTGTTT
CCCAGGTGCCAGATGT 3C3 VL2 signal sequence:
(SEQ ID NO: 325)
MEAPAQLLFLLLLWLPDTTG (SEQ ID NO: 326)
ATGGAAGCCCCAGCGCAGCTTCTCTTCCTCCTGCTACTCTGGCTCCCAGA
TACCACCGGA 8A6 VH signal sequence:
(SEQ ID NO: 327)
MEFGLNWVFLVALLRGVQC (SEQ ID NO: 328)
ATGGAGTTTGGGCTGAACTGGGTTTTCCTCGTTGCTCTTTTAAGAGGTGT
CCAGTGT 8A6 VL signal sequence:
(SEQ ID NO: 317)
MDMRVPAQLLGLLLLWLPGARC (SEQ ID NO: 318)
ATGGACATGAGGGTCCCCGCTCAGCTCCTGGGGCTTCTGCTGCTCTGGCT
CCCAGGTGCCAGATGT 9G7 VH signal sequence:
(SEQ ID NO: 329)
MEFGLSWIFLAAILKGVQC (SEQ ID NO: 330)
ATGGAGTTTGGGCTGAGCTGGATTTTCCTTGCTGCTATTTTAAAAGGTGT
CCAGTGT 9G7 VL1 and VL2 signal sequence:
(SEQ ID NO: 331)
METPAQLLFLLLLWLPDTTG (SEQ ID NO: 332)
ATGGAAACCCCAGCGCAGCTTCTCTTCCTCCTGCTACTCTGGCTCCCAGA
TACCACCGGA 14E3 VH signal sequence:
(SEQ ID NO: 333)
MKHLWFFLLLVAAPRWVLS (SEQ ID NO: 334)
ATGAAACACCTGTGGTTCTTCCTCCTCCTGGTGGCAGCTCCCAGATGGGT
CCTGTCC 14E3 VL signal sequence:
(SEQ ID NO: 323)
MDMRVLAQLLGLLLLCFPGARC (SEQ ID NO: 324)
ATGGACATGAGGGTCCTCGCTCAGCTCCTGGGGCTCCTGCTGCTCTGTTT
CCCAGGTGCCAGATGT 19H8 VH signal sequence:
(SEQ ID NO: 315)
MEFGLSWVFLVALLRGVQC (SEQ ID NO: 316)
ATGGAGTTTGGGCTGAGCTGGGTTTTCCTCGTTGCTCTTTTAAGAGGTGT
CCAGTGT 19H8 VL1 signal sequence:
(SEQ ID NO: 317)
MDMRVPAQLLGLLLLWLPGARC (SEQ ID NO: 318)
ATGGACATGAGGGTCCCCGCTCAGCTCCTGGGGCTTCTGCTGCTCTGGCT
CCCAGGTGCCAGATGT 19H8 VL2 signal sequence:
(SEQ ID NO: 325)
MEAPAQLLFLLLLWLPDTTG (SEQ ID NO: 326)
ATGGAAGCCCCAGCTCAGCTTCTCTTCCTCCTGCTACTCTGGCTCCCAGA
TACCACCGGA 6G10 VH signal sequence:
(SEQ ID NO: 315)
MEFGLSWVFLVALLRGVQC (SEQ ID NO: 316)
ATGGAGTTTGGGCTGAGCTGGGTTTTCCTCGTTGCTCTTTTAAGAGGTGT
CCAGTGT 6G10 VL signal sequence:
(SEQ ID NO: 317)
MDMRVPAQLLGLLLLWLPGARC (SEQ ID NO: 318)
ATGGACATGAGGGTCCCCGCTCAGCTCCTGGGGCTTCTGCTGCTCTGGCT
CCCAGGTGCCAGATGT The signal sequence MRAWIFFLLCLAGRALA (SEQ ID NO: 367) may be used for expressing heavy and light chains.

Heavy and light chains or portions thereof, such as those provided in Table 15 may be linked to a signal sequence provided herein. For example, 28F3 heavy chain or variable region thereof, e.g., comprising SEQ ID NO: 13, 15, 17, or 18 may be linked or fused to a signal peptide comprising or consisting of MEFGLSWVFLVALLRGVQC (SEQ ID NO: 315) or MRAWIFFLLCLAGRALA (SEQ ID NO: 367). 28F3 light chain or variable region thereof, e.g., comprising SEQ ID NO: 14, 16, or 19 may be linked or fused to a signal peptide comprising or consisting of MDMRVPAQLLGLLLLWLPGARC (SEQ ID NO: 317) or MRAWIFFLLCLAGRALA (SEQ ID NO: 367).

In addition to the antibody chain genes, recombinant expression vectors may carry regulatory sequences that control the expression of the antibody chain genes in a host cell. The term "regulatory sequence" is intended to include promoters, enhancers and other expression control elements (e.g., polyadenylation signals) that control the transcription or translation of the antibody chain genes. Such regulatory sequences are described, for example, in Goeddel (Gene Expression Technology. Methods in Enzymology 185, Academic Press, San Diego, Calif. (1990)). It will be appreciated by those skilled in the art that the design of the expression vector, including the selection of regulatory sequences, may depend on such factors as the choice of the host cell to be transformed, the level of expression of protein desired, etc. Preferred regulatory sequences for mammalian host cell expression include viral elements that direct high levels of protein expression in mammalian cells, such as promoters and/or enhancers derived from cytomegalovirus (CMV), Simian Virus 40 (SV40), adenovirus, (e.g., the adenovirus major late promoter (AdMLP) and polyoma. Alternatively, nonviral regulatory sequences may be used, such as the ubiquitin promoter or β-globin promoter. Still further, regulatory elements composed of sequences from different sources, such as the SRα promoter system, which contains sequences from the SV40 early promoter and the long terminal repeat of human T cell leukemia virus type 1 (Takebe, Y. et al. (1988) *Mol. Cell. Biol.* 8:466-472).

In addition to the antibody chain genes and regulatory sequences, recombinant expression vectors may carry additional sequences, such as sequences that regulate replication of the vector in host cells (e.g., origins of replication) and selectable marker genes. The selectable marker gene facilitates selection of host cells into which the vector has been introduced (see, e.g., U.S. Pat. Nos. 4,399,216, 4,634,665 and 5,179,017, all by Axel et al.). For example, typically the selectable marker gene confers resistance to drugs, such as G418, hygromycin or methotrexate, on a host cell into which the vector has been introduced. Preferred selectable marker genes include the dihydrofolate reductase (DHFR) gene (for use in dhfr− host cells with methotrexate selection/amplification) and the neo gene (for G418 selection).

For expression of the light and heavy chains, the expression vector(s) encoding the heavy and light chains is transfected into a host cell by standard techniques. The various forms of the term "transfection" are intended to encompass a wide variety of techniques commonly used for the introduction of exogenous DNA into a prokaryotic or eukaryotic host cell, e.g., electroporation, calcium-phosphate precipitation, DEAE-dextran transfection and the like. Although it is theoretically possible to express the antibodies described herein in either prokaryotic or eukaryotic host cells, expression of antibodies in eukaryotic cells, and most preferably mammalian host cells, is the most preferred because such eukaryotic cells, and in particular mammalian cells, are more likely than prokaryotic cells to assemble and secrete a properly folded and immunologically active antibody. Prokaryotic expression of antibody genes has been reported to be ineffective for production of high yields of active antibody (Boss, M. A. and Wood, C. R. (1985) *Immunology Today* 6:12-13).

Preferred mammalian host cells for expressing the recombinant antibodies described herein include Chinese Hamster Ovary (CHO cells) (including dhfr− CHO cells, described in Urlaub and Chasin, (1980) *Proc. Natl. Acad. Sci. USA* 77:4216-4220, used with a DHFR selectable marker, e.g., as described in R. J. Kaufman and P. A. Sharp (1982) *Mol. Biol.* 159:601-621), NSO myeloma cells, COS cells and SP2 cells. In particular, for use with NSO myeloma cells, another preferred expression system is the GS gene expression system disclosed in WO 87/04462, WO 89/01036 and EP 338,841. When recombinant expression vectors encoding antibody genes are introduced into mammalian host cells, the antibodies are produced by culturing the host cells for a period of time sufficient to allow for expression of the antibody in the host cells or, more preferably, secretion of the antibody into the culture medium in which the host cells are grown. Antibodies can be recovered from the culture medium using standard protein purification methods.

XII. Assays

Antibodies described herein can be tested for binding to GITR by, for example, standard ELISA. Briefly, microtiter plates are coated with purified GITR at 1-2 µg/ml in PBS, and then blocked with 5% bovine serum albumin in PBS. Dilutions of antibody (e.g., dilutions of plasma from GITR-immunized mice) are added to each well and incubated for 1-2 hours at 37° C. The plates are washed with PBS/Tween and then incubated with secondary reagent (e.g., for human antibodies, a goat-anti-human IgG Fc-specific polyclonal reagent) conjugated to horseradish peroxidase (HRP) for 1 hour at 37° C. After washing, the plates are developed with ABTS substrate (Moss Inc, product: ABTS-1000) and analyzed by a spectrophotometer at OD 415-495. Sera from immunized mice are then further screened by flow cytometry for binding to a cell line expressing human GITR, but not to a control cell line that does not express GITR. Briefly, the binding of anti-GITR antibodies is assessed by incubating GITR expressing CHO cells with the anti-GITR antibody at 1:20 dilution. The cells are washed and binding is detected with a PE-labeled anti-human IgG Ab. Flow cytometric analyses are performed using a FACScan flow cytometry (Becton Dickinson, San Jose, Calif.). Preferably, mice which develop the highest titers will be used for fusions.

An ELISA assay as described above can be used to screen for antibodies and, thus, hybridomas that produce antibodies that show positive reactivity with the GITR immunogen. Hybridomas that produce antibodies that bind, preferably with high affinity, to GITR can then be subcloned and further characterized. One clone from each hybridoma, which retains the reactivity of the parent cells (by ELISA), can then be chosen for making a cell bank, and for antibody purification.

To purify anti-GITR antibodies, selected hybridomas can be grown in two-liter spinner-flasks for monoclonal antibody purification. Supernatants can be filtered and concentrated before affinity chromatography with protein A-sepharose (Pharmacia, Piscataway, N.J.). Eluted IgG can be checked by gel electrophoresis and high performance liquid chromatography to ensure purity. The buffer solution can be exchanged into PBS, and the concentration can be determined by $OD_{280}$ using 1.43 extinction coefficient. The monoclonal antibodies can be aliquoted and stored at −80° C.

To determine if the selected anti-GITR monoclonal antibodies bind to unique epitopes, each antibody can be biotinylated using commercially available reagents (Pierce, Rockford, Ill.). Biotinylated MAb binding can be detected with a streptavidin labeled probe. Competition studies using unlabeled monoclonal antibodies and biotinylated monoclonal antibodies can be performed using GITR coated-ELISA plates as described above.

To determine the isotype of purified antibodies, isotype ELISAs can be performed using reagents specific for antibodies of a particular isotype. For example, to determine the isotype of a human monoclonal antibody, wells of microtiter plates can be coated with 1 µg/ml of anti-human immunoglobulin overnight at 4° C. After blocking with 1% BSA, the plates are reacted with 1 µg/ml or less of test monoclonal antibodies or purified isotype controls, at ambient temperature for one to two hours. The wells can then be reacted with either human IgG1 or human IgM-specific alkaline phosphatase-conjugated probes. Plates are developed and analyzed as described above.

To test the binding of monoclonal antibodies to live cells expressing GITR, flow cytometry can be used, as described in the Examples. Briefly, cell lines expressing membrane-bound GITR (grown under standard growth conditions) are mixed with various concentrations of monoclonal antibodies in PBS containing 0.1% BSA at 4° C. for 1 hour. After washing, the cells are reacted with Fluorescein-labeled anti-IgG antibody under the same conditions as the primary antibody staining. The samples can be analyzed by FACScan instrument using light and side scatter properties to gate on single cells and binding of the labeled antibodies is determined. An alternative assay using fluorescence microscopy may be used (in addition to or instead of) the flow cytometry assay. Cells can be stained exactly as described above and examined by fluorescence microscopy. This method allows visualization of individual cells, but may have diminished sensitivity depending on the density of the antigen.

Anti-GITR antibodies can be further tested for reactivity with the GITR antigen by Western blotting. Briefly, cell extracts from cells expressing GITR can be prepared and subjected to sodium dodecyl sulfate polyacrylamide gel electrophoresis. After electrophoresis, the separated antigens will be transferred to nitrocellulose membranes, blocked with 20% mouse serum, and probed with the monoclonal antibodies to be tested. IgG binding can be detected using anti-IgG alkaline phosphatase and developed with BCIP/NBT substrate tablets (Sigma Chem. Co., St. Louis, Mo.).

Methods for analyzing binding affinity, cross-reactivity, and binding kinetics of various anti-GITR antibodies include standard assays known in the art, for example, Biacore™ surface plasmon resonance (SPR) analysis using a Biacore™ 2000 SPR instrument (Biacore AB, Uppsala, Sweden).

In one embodiment, an antibody specifically binds to the extracellular region of human GITR. An antibody may specifically bind to a particular domain (e.g., a functional domain) within the extracellular domain of GITR. In a particular embodiment, the antibody specifically binds to the site on GITR to which GITR-L binds. In certain embodiments, the antibody specifically binds to the extracellular region of human GITR and the extracellular region of cynomolgus GITR. Preferably, an antibody binds to human GITR with high affinity.

XIII. Immunoconjugates, Antibody Derivatives and Diagnostics

Antibodies described herein can be used for diagnostic purposes, including sample testing and in vivo imaging, and for this purpose the antibody (or binding fragment thereof) can be conjugated to an appropriate detectable agent, to form an immunoconjugate. For diagnostic purposes, appropriate agents are detectable labels that include radioisotopes, for whole body imaging, and radioisotopes, enzymes, fluorescent labels and other suitable antibody tags for sample testing.

The detectable labels can be any of the various types used currently in the field of in vitro diagnostics, including particulate labels including metal sols such as colloidal gold, isotopes such as $I^{125}$ or $Tc^{99}$ presented for instance with a peptidic chelating agent of the $N_2S_2$, $N_3S$ or $N_4$ type, chromophores including fluorescent markers, luminescent markers, phosphorescent markers and the like, as well as enzyme labels that convert a given substrate to a detectable marker, and polynucleotide tags that are revealed following amplification such as by polymerase chain reaction. Suitable enzyme labels include horseradish peroxidase, alkaline phosphatase and the like. For instance, the label can be the enzyme alkaline phosphatase, detected by measuring the presence or formation of chemiluminescence following conversion of 1,2 dioxetane substrates such as adamantyl methoxy phosphoryloxy phenyl dioxetane (AMPPD), disodium 3-(4-(methoxyspiro{1,2-dioxetane-3,2'-(5'-chloro)tricyclo{3.3.1.1 3,7}decan}-4-yl) phenyl phosphate (CSPD), as well as CDP and CDP-Star® or other luminescent substrates well-known to those in the art, for example the chelates of suitable lanthanides such as Terbium(III) and Europium(III). The detection means is determined by the chosen label. Appearance of the label or its reaction products can be achieved using the naked eye, in the case where the label is particulate and accumulates at appropriate levels, or using instruments such as a spectrophotometer, a luminometer, a fluorimeter, and the like, all in accordance with standard practice.

Preferably, conjugation methods result in linkages which are substantially (or nearly) non-immunogenic, e.g., peptide- (i.e. amide-), sulfide-, (sterically hindered), disulfide-, hydrazone-, and ether linkages. These linkages are nearly non-immunogenic and show reasonable stability within serum (see e.g. Senter, P. D., Curr. Opin. Chem. Biol. 13 (2009) 235-244; WO 2009/059278; WO 95/17886).

Depending on the biochemical nature of the moiety and the antibody, different conjugation strategies can be employed. In case the moiety is naturally occurring or recombinant of between 50 to 500 amino acids, there are standard procedures in text books describing the chemistry for synthesis of protein conjugates, which can be easily followed by the skilled artisan (see e.g. Hackenberger, C. P. R., and Schwarzer, D., Angew. Chem. Int. Ed. Engl. 47 (2008) 10030-10074). In one embodiment the reaction of a maleinimido moiety with a cysteine residue within the antibody or the moiety is used. This is an especially suited coupling chemistry in case e.g. a Fab or Fab'-fragment of an antibody is used. Alternatively in one embodiment coupling to the C-terminal end of the antibody or moiety is performed. C-terminal modification of a protein, e.g. of a Fab-fragment can e.g. be performed as described (Sunbul, M. and Yin, J., Org. Biomol. Chem. 7 (2009) 3361-3371).

In general, site specific reaction and covalent coupling is based on transforming a natural amino acid into an amino acid with a reactivity which is orthogonal to the reactivity of the other functional groups present. For example, a specific cysteine within a rare sequence context can be enzymatically converted in an aldehyde (see Frese, M. A., and Dierks, T., ChemBioChem. 10 (2009) 425-427). It is also possible to obtain a desired amino acid modification by utilizing the specific enzymatic reactivity of certain enzymes with a natural amino acid in a given sequence context (see, e.g., Taki, M. et al., Prot. Eng. Des. Sel. 17 (2004) 119-126; Gautier, A. et al. Chem. Biol. 15 (2008) 128-136; and Protease-catalyzed formation of C—N bonds is used by Bordusa, F., Highlights in Bioorganic Chemistry (2004) 389-403).

Site specific reaction and covalent coupling can also be achieved by the selective reaction of terminal amino acids with appropriate modifying reagents.

The reactivity of an N-terminal cysteine with benzonitrils (see Ren, H. et al., Angew. Chem. Int. Ed. Engl. 48 (2009) 9658-9662) can be used to achieve a site-specific covalent coupling.

Native chemical ligation can also rely on C-terminal cysteine residues (Taylor, E. Vogel; Imperiali, B, Nucleic Acids and Molecular Biology (2009), 22 (Protein Engineering), 65-96).

EP 1 074 563 describes a conjugation method which is based on the faster reaction of a cysteine within a stretch of negatively charged amino acids with a cysteine located in a stretch of positively charged amino acids.

The moiety may also be a synthetic peptide or peptide mimic. In case a polypeptide is chemically synthesized, amino acids with orthogonal chemical reactivity can be incorporated during such synthesis (see e.g. de Graaf, A. J. et al., Bioconjug. Chem. 20 (2009) 1281-1295). Since a great variety of orthogonal functional groups is at stake and can be introduced into a synthetic peptide, conjugation of such peptide to a linker is standard chemistry.

In order to obtain a mono-labeled polypeptide, the conjugate with 1:1 stoichiometry may be separated by chromatography from other conjugation side-products. This procedure can be facilitated by using a dye labeled binding pair member and a charged linker. By using this kind of labeled and highly negatively charged binding pair member, mono conjugated polypeptides are easily separated from non-labeled polypeptides and polypeptides which carry more than one linker, since the difference in charge and molecular weight can be used for separation. The fluorescent dye can be useful for purifying the complex from un-bound components, like a labeled monovalent binder.

In one embodiment the moiety attached to an anti-GITR antibody is selected from the group consisting of a binding moiety, a labeling moiety, and a biologically active moiety.

Antibodies described herein may also be conjugated to a therapeutic agent to form an immunoconjugate such as an antibody-drug conjugate (ADC). Suitable therapeutic agents include antimetabolites, alkylating agents, DNA minor groove binders, DNA intercalators, DNA crosslinkers, histone deacetylase inhibitors, nuclear export inhibitors, proteasome inhibitors, topoisomerase I or II inhibitors, heat shock protein inhibitors, tyrosine kinase inhibitors, antibiotics, and anti-mitotic agents. In the ADC, the antibody and therapeutic agent preferably are conjugated via a linker cleavable such as a peptidyl, disulfide, or hydrazone linker. More preferably, the linker is a peptidyl linker such as Val-Cit, Ala-Val, Val-Ala-Val, Lys-Lys, Pro-Val-Gly-Val-Val (SEQ ID NO: 219), Ala-Asn-Val, Val-Leu-Lys, Ala-Ala-Asn, Cit-Cit, Val-Lys, Lys, Cit, Ser, or Glu. The ADCs can be prepared as described in U.S. Pat. Nos. 7,087,600; 6,989,452; and 7,129,261; PCT Publications WO 02/096910; WO 07/038658; WO 07/051081; WO 07/059404; WO 08/083312; and WO 08/103693; U.S. Patent Publications 20060024317; 20060004081; and 20060247295; the disclosures of which are incorporated herein by reference.

Anti-GITR antibodies, e.g., those described herein, may also be used for detecting GITR, such as human GITR, e.g., human GITR in tissues or tissue samples. The antibodies may be used, e.g., in an ELISA assay or in flow cytometry. In certain embodiments, an anti-GITR antibody is contacted with cells, e.g., cells in a tissue, for a time appropriate for specific binding to occur, and then a reagent, e.g., an antibody that detects the anti-GITR antibody, is added. Exemplary assays are provided in the Examples. The anti-GITR antibody may be a fully human antibody, or it may be a chimeric antibody, such as an antibody having human variable regions and murine constant regions or a portion thereof. Exemplary methods for detecting GITR, e.g., human GITR, in a sample (cell or tissue sample) comprise (i) contacting a sample with an anti-GITR antibody, for a time sufficient for allowing specific binding of the anti-GITR antibody to GITR in the sample, and (2) contacting the sample with a detection reagent, e.g., an antibody, that specifically binds to the anti-GITR antibody, such as to the Fc region of the anti-GITR antibody, to thereby detect GITR bound by the anti-GITR antibody. Wash steps may be included after the incubation with the antibody and/or detection reagent. Anti-GITR antibodies for use in these methods do not have to be linked to a label or detection agents, as a separate detection agent can be used.

Other uses for anti-GITR antibodies, e.g., as monotherapy or combination therapy, are provided elsewhere herein, e.g., in the section pertaining to combination treatments.

XIV. Bispecific Molecules

Antibodies described herein may be used for forming bispecific molecules. An anti-GITR antibody, or antigen-binding portions thereof, can be derivatized or linked to another functional molecule, e.g., another peptide or protein (e.g., another antibody or ligand for a receptor) to generate a bispecific molecule that binds to at least two different binding sites or target molecules. For example, an anti-GITR antibody may be linked to an antibody or scFv that binds specifically to any protein that may be used as potential targets for combination treatments, such as the proteins described herein (e.g., antibodies to PD-1, PD-L1, or LAG-3). The antibody described herein may in fact be derivatized or linked to more than one other functional molecule to generate multispecific molecules that bind to more than two different binding sites and/or target molecules; such multispecific molecules are also intended to be encompassed by the term "bispecific molecule" as used herein. To create a bispecific molecule described herein, an antibody described herein can be functionally linked (e.g., by chemical coupling, genetic fusion, noncovalent association or otherwise) to one or more other binding molecules, such as another antibody, antibody fragment, peptide or binding mimetic, such that a bispecific molecule results.

Accordingly, provided herein are bispecific molecules comprising at least one first binding specificity for GITR and a second binding specificity for a second target epitope. In an embodiment described herein in which the bispecific molecule is multispecific, the molecule can further include a third binding specificity.

In one embodiment, the bispecific molecules described herein comprise as a binding specificity at least one antibody, or an antibody fragment thereof, including, e.g., an Fab, Fab', F(ab')$_2$, Fv, or a single chain Fv (scFv). The antibody may also be a light chain or heavy chain dimer, or any minimal fragment thereof such as a Fv or a single chain construct as described in Ladner et al. U.S. Pat. No. 4,946,778, the contents of which is expressly incorporated by reference.

While human monoclonal antibodies are preferred, other antibodies which can be employed in the bispecific molecules described herein are murine, chimeric and humanized monoclonal antibodies.

The bispecific molecules described herein can be prepared by conjugating the constituent binding specificities using methods known in the art. For example, each binding specificity of the bispecific molecule can be generated separately and then conjugated to one another. When the binding specificities are proteins or peptides, a variety of coupling or cross-linking agents can be used for covalent conjugation. Examples of cross-linking agents include protein A, carbodiimide, N-succinimidyl-S-acetyl-thioacetate (SATA), 5,5'-dithiobis(2-nitrobenzoic acid) (DTNB), o-phenylenedimaleimide (oPDM), N-succinimidyl-3-(2-pyridyldithio)propionate (SPDP), and sulfosuccinimidyl 4-(N-maleimidomethyl) cyclohaxane-1-carboxylate (sulfo-SMCC) (see e.g., Karpovsky et al. (1984) *J. Exp. Med.* 160:1686; Liu, M A et al. (1985) *Proc. Natl. Acad. Sci. USA* 82:8648). Other methods include those described in Paulus (1985) *Behring Ins. Mitt. No.* 78, 118-132; Brennan et al. (1985) *Science* 229:81-83), and Glennie et al. (1987) *J. Immunol.* 139: 2367-2375). Preferred conjugating agents are SATA and sulfo-SMCC, both available from Pierce Chemical Co. (Rockford, Ill.).

When the binding specificities are antibodies, they can be conjugated via sulfhydryl bonding of the C-terminus hinge regions of the two heavy chains. In a particularly preferred embodiment, the hinge region is modified to contain an odd number of sulfhydryl residues, preferably one, prior to conjugation.

Alternatively, both binding specificities can be encoded in the same vector and expressed and assembled in the same host cell. This method is particularly useful where the bispecific molecule is a mAb×mAb, mAb×Fab, mAb× (scFv)$_2$, Fab×F(ab')$_2$ or ligand x Fab fusion protein. A bispecific antibody may comprise an antibody comprising an scFv at the C-terminus of each heavy chain. A bispecific molecule described herein can be a single chain molecule comprising one single chain antibody and a binding determinant, or a single chain bispecific molecule comprising two binding determinants. Bispecific molecules may comprise at least two single chain molecules. Methods for preparing bispecific molecules are described for example in U.S. Pat. Nos. 5,260,203; 5,455,030; 4,881,175; 5,132,405; 5,091,513; 5,476,786; 5,013,653; 5,258,498; and 5,482,858.

Binding of the bispecific molecules to their specific targets can be confirmed using art-recognized methods, such as enzyme-linked immunosorbent assay (ELISA), radioimmunoassay (RIA), FACS analysis, bioassay (e.g., growth inhibition), or Western Blot assay. Each of these assays generally detects the presence of protein-antibody complexes of particular interest by employing a labeled reagent (e.g., an antibody) specific for the complex of interest.

XV. Compositions

Further provided are compositions, e.g., a pharmaceutical compositions, containing one or a combination of anti-GITR antibodies or combination with antibodies to other targets, or antigen-binding portion(s) thereof, described herein, formulated together with a pharmaceutically acceptable carrier. Such compositions may include one or a combination of (e.g., two or more different) antibodies, or immunoconjugates or bispecific molecules described herein. For example, a pharmaceutical composition described herein can comprise a combination of antibodies (or immunoconjugates or bispecifics) that bind to different epitopes on the target antigen or that have complementary activities.

In certain embodiments, a composition comprises an anti-GITR antibody at a concentration of at least 1 mg/ml, 5 mg/ml, 10 mg/ml, 50 mg/ml, 100 mg/ml, 150 mg/ml, 200 mg/ml, 1-300 mg/ml, or 100-300 mg/ml.

Pharmaceutical compositions described herein also can be administered in combination therapy, i.e., combined with other agents. For example, the combination therapy can include an anti-GITR antibody described herein combined with at least one other anti-cancer and/or T-cell stimulating (e.g., activating) agent. Examples of therapeutic agents that can be used in combination therapy are described in greater detail below in the section on uses of the antibodies described herein.

In some embodiments, therapeutic compositions disclosed herein can include other compounds, drugs, and/or agents used for the treatment of cancer. Such compounds, drugs, and/or agents can include, for example, chemotherapy drugs, small molecule drugs or antibodies that stimulate the immune response to a given cancer. In some instances, therapeutic compositions can include, for example, one or more of an anti-CTLA-4 antibody, an anti-PD-1 antibody, an anti-PDL-1 antibody, an anti-OX40 (also known as CD134, TNFRSF4, ACT35 and/or TXGP1L) antibody, an anti-CD137 antibody, or an anti-LAG-3 antibody.

As used herein, "pharmaceutically acceptable carrier" includes any and all solvents, dispersion media, coatings, antibacterial and antifungal agents, isotonic and absorption delaying agents, and the like that are physiologically compatible. Preferably, the carrier is suitable for intravenous, intramuscular, subcutaneous, parenteral, spinal or epidermal administration (e.g., by injection or infusion). Depending on the route of administration, the active compound, i.e., antibody, immunoconjugate, or bispecific molecule, may be coated in a material to protect the compound from the action of acids and other natural conditions that may inactivate the compound.

The pharmaceutical compounds described herein may include one or more pharmaceutically acceptable salts. A "pharmaceutically acceptable salt" refers to a salt that retains the desired biological activity of the parent compound and does not impart any undesired toxicological effects (see e.g., Berge, S. M., et al. (1977) *J. Pharm. Sci.* 66:1-19). Examples of such salts include acid addition salts and base addition salts. Acid addition salts include those derived from nontoxic inorganic acids, such as hydrochloric, nitric, phosphoric, sulfuric, hydrobromic, hydroiodic, phosphorous and the like, as well as from nontoxic organic acids such as aliphatic mono- and dicarboxylic acids, phenyl-substituted alkanoic acids, hydroxy alkanoic acids, aromatic acids, aliphatic and aromatic sulfonic acids and the like. Base addition salts include those derived from alkaline earth metals, such as sodium, potassium, magnesium, calcium and the like, as well as from nontoxic organic amines, such as N,N'-dibenzylethylenediamine, N-methylglucamine, chloroprocaine, choline, diethanolamine, ethylenediamine, procaine and the like.

A pharmaceutical composition described herein may also include a pharmaceutically acceptable anti-oxidant. Examples of pharmaceutically acceptable antioxidants include: (1) water soluble antioxidants, such as ascorbic acid, cysteine hydrochloride, sodium bisulfate, sodium metabisulfite, sodium sulfite and the like; (2) oil-soluble antioxidants, such as ascorbyl palmitate, butylated hydroxyanisole (BHA), butylated hydroxytoluene (BHT), lecithin, propyl gallate, alpha-tocopherol, and the like; and (3) metal chelating agents, such as citric acid, ethylenediamine tetraacetic acid (EDTA), sorbitol, tartaric acid, phosphoric acid, and the like.

Examples of suitable aqueous and nonaqueous carriers that may be employed in the pharmaceutical compositions described herein include water, ethanol, polyols (such as glycerol, propylene glycol, polyethylene glycol, and the like), and suitable mixtures thereof, vegetable oils, such as olive oil, and injectable organic esters, such as ethyl oleate. Proper fluidity can be maintained, for example, by the use of coating materials, such as lecithin, by the maintenance of the required particle size in the case of dispersions, and by the use of surfactants.

These compositions may also contain adjuvants such as preservatives, wetting agents, emulsifying agents and dispersing agents. Prevention of presence of microorganisms may be ensured both by sterilization procedures, supra, and by the inclusion of various antibacterial and antifungal agents, for example, paraben, chlorobutanol, phenol sorbic acid, and the like. It may also be desirable to include isotonic agents, such as sugars, sodium chloride, and the like into the compositions. In addition, prolonged absorption of the injectable pharmaceutical form may be brought about by the inclusion of agents which delay absorption such as aluminum monostearate and gelatin.

Pharmaceutically acceptable carriers include sterile aqueous solutions or dispersions and sterile powders for the extemporaneous preparation of sterile injectable solutions or dispersion. The use of such media and agents for pharmaceutically active substances is known in the art. Except insofar as any conventional media or agent is incompatible with the active compound, use thereof in the pharmaceutical compositions described herein is contemplated. A pharmaceutical composition may comprise a preservative or may be devoid of a preservative. Supplementary active compounds can be incorporated into the compositions.

Therapeutic compositions typically must be sterile and stable under the conditions of manufacture and storage. The composition can be formulated as a solution, microemulsion, liposome, or other ordered structure suitable to high drug concentration. The carrier can be a solvent or dispersion medium containing, for example, water, ethanol, polyol (for example, glycerol, propylene glycol, and liquid polyethylene glycol, and the like), and suitable mixtures thereof. The proper fluidity can be maintained, for example, by the use of a coating such as lecithin, by the maintenance of the required particle size in the case of dispersion and by the use of surfactants. In many cases, it will be preferable to include isotonic agents, for example, sugars, polyalcohols such as mannitol, sorbitol, or sodium chloride in the composition. Prolonged absorption of the injectable compositions can be brought about by including in the composition an agent that delays absorption, for example, monostearate salts and gelatin.

Sterile injectable solutions can be prepared by incorporating the active compound in the required amount in an appropriate solvent with one or a combination of ingredients enumerated above, as required, followed by sterilization microfiltration. Generally, dispersions are prepared by incorporating the active compound into a sterile vehicle that contains a basic dispersion medium and the required other ingredients from those enumerated herein. In the case of sterile powders for the preparation of sterile injectable solutions, the preferred methods of preparation are vacuum drying and freeze-drying (lyophilization) that yield a powder of the active ingredient plus any additional desired ingredient from a previously sterile-filtered solution thereof.

The amount of active ingredient which can be combined with a carrier material to produce a single dosage form will vary depending upon the subject being treated, and the particular mode of administration. The amount of active ingredient which can be combined with a carrier material to produce a single dosage form will generally be that amount of the composition which produces a therapeutic effect. Generally, out of one hundred percent, this amount will range from about 0.01 percent to about ninety-nine percent of active ingredient, preferably from about 0.1 percent to about 70 percent, most preferably from about 1 percent to about 30 percent of active ingredient in combination with a pharmaceutically acceptable carrier.

Dosage regimens are adjusted to provide the optimum desired response (e.g., a therapeutic response). For example, a single bolus may be administered, several divided doses may be administered over time or the dose may be proportionally reduced or increased as indicated by the exigencies of the therapeutic situation. It is especially advantageous to formulate parenteral compositions in dosage unit form for ease of administration and uniformity of dosage. Dosage unit form as used herein refers to physically discrete units suited as unitary dosages for the subjects to be treated; each unit contains a predetermined quantity of active compound calculated to produce the desired therapeutic effect in association with the required pharmaceutical carrier. The specification for the dosage unit forms described herein are dictated by and directly dependent on (a) the unique characteristics of the active compound and the particular therapeutic effect to be achieved, and (b) the limitations inherent in the art of compounding such an active compound for the treatment of sensitivity in individuals.

For administration of the antibody, the dosage ranges from about 0.0001 to 100 mg/kg, and more usually 0.01 to 5 or 10 mg/kg, of the host body weight. For example dosages can be 0.3 mg/kg body weight, 1 mg/kg body weight, 3 mg/kg body weight, 5 mg/kg body weight or 10 mg/kg body weight or within the range of 1-10 mg/kg. An exemplary treatment regime entails administration once per week, once every two weeks, once every three weeks, once every four weeks, once a month, once every 3 months or once every three to 6 months. Preferred dosage regimens for an anti-GITR antibody described herein include 1 mg/kg body weight or 3 mg/kg body weight via intravenous administration, with the antibody being given using one of the following dosing schedules: (i) every four weeks for six dosages, then every three months; (ii) every three weeks; (iii) 3 mg/kg body weight once followed by 1 mg/kg body weight every three weeks.

An anti-GITR antibody may be administered at a flat dose (flat dose regimen).

In some methods, two or more monoclonal antibodies with different binding specificities are administered simultaneously, in which case the dosage of each antibody administered falls within the ranges indicated. Antibody is usually administered on multiple occasions. Intervals between single dosages can be, for example, weekly, monthly, every three months or yearly. Intervals can also be irregular as indicated by measuring blood levels of antibody to the target antigen in the patient. In some methods, dosage is adjusted to achieve a plasma antibody concentration of about 1-1000 µg/ml and in some methods about 25-300 µg/ml.

An anti-GITR antibody may be administered with another antibody at the dosage regimen of the other antibody. For example, an anti-GITR antibody may be administered with an anti-PD-1 antibody, such as nivolumab (OPDIVO), every two weeks as an i.v. infusion over 60 minutes until disease progression or unacceptable toxicity occurs. An anti-GITR antibody may be administered with pembrolizumab (KEYTRUDA) every 3 weeks as an i.v. infusion over 30 minutes until disease progression or unacceptable toxicity occurs.

An antibody can be administered as a sustained release formulation, in which case less frequent administration is required. Dosage and frequency vary depending on the half-life of the antibody in the patient. In general, human antibodies show the longest half-life, followed by humanized antibodies, chimeric antibodies, and nonhuman antibodies. The dosage and frequency of administration can vary depending on whether the treatment is prophylactic or therapeutic. In prophylactic applications, a relatively low dosage is administered at relatively infrequent intervals over a long period of time. Some patients continue to receive treatment for the rest of their lives. In therapeutic applications, a relatively high dosage at relatively short intervals is sometimes required until progression of the disease is reduced or terminated, and preferably until the patient shows partial or complete amelioration of symptoms of disease. Thereafter, the patient can be administered a prophylactic regime.

Actual dosage levels of the active ingredients in the pharmaceutical compositions described herein may be varied so as to obtain an amount of the active ingredient which is effective to achieve the desired therapeutic response for a particular patient, composition, and mode of administration, without being toxic to the patient. The selected dosage level will depend upon a variety of pharmacokinetic factors including the activity of the particular compositions described herein employed, or the ester, salt or amide thereof, the route of administration, the time of administration, the rate of excretion of the particular compound being employed, the duration of the treatment, other drugs, compounds and/or materials used in combination with the particular compositions employed, the age, sex, weight, condition, general health and prior medical history of the patient being treated, and like factors well known in the medical arts.

A "therapeutically effective dosage" of an anti-GITR antibody described herein preferably results in a decrease in severity of disease symptoms, an increase in frequency and duration of disease symptom-free periods, or a prevention of impairment or disability due to the disease affliction. In the context of cancer, a therapeutically effective dose preferably results in increased survival, and/or prevention of further deterioration of physical symptoms associated with cancer. Symptoms of cancer are well-known in the art and include, for example, unusual mole features, a change in the appearance of a mole, including asymmetry, border, color and/or diameter, a newly pigmented skin area, an abnormal mole, darkened area under nail, breast lumps, nipple changes, breast cysts, breast pain, death, weight loss, weakness, excessive fatigue, difficulty eating, loss of appetite, chronic cough, worsening breathlessness, coughing up blood, blood in the urine, blood in stool, nausea, vomiting, liver metastases, lung metastases, bone metastases, abdominal fullness, bloating, fluid in peritoneal cavity, vaginal bleeding, constipation, abdominal distension, perforation of colon, acute peritonitis (infection, fever, pain), pain, vomiting blood, heavy sweating, fever, high blood pressure, anemia, diarrhea, jaundice, dizziness, chills, muscle spasms, colon metastases, lung metastases, bladder metastases, liver metastases, bone metastases, kidney metastases, and pancreatic metastases, difficulty swallowing, and the like.

A therapeutically effective dose may prevent or delay onset of cancer, such as may be desired when early or preliminary signs of the disease are present. Laboratory tests utilized in the diagnosis of cancer include chemistries (including the measurement of GITR levels), hematology, serology and radiology. Accordingly, any clinical or biochemical assay that monitors any of the foregoing may be used to determine whether a particular treatment is a therapeutically effective dose for treating cancer. One of ordinary skill in the art would be able to determine such amounts based on such factors as the subject's size, the severity of the subject's symptoms, and the particular composition or route of administration selected.

A composition described herein can be administered via one or more routes of administration using one or more of a variety of methods known in the art. As will be appreciated by the skilled artisan, the route and/or mode of administration will vary depending upon the desired results. Preferred routes of administration for antibodies described herein include intravenous, intramuscular, intradermal, intraperitoneal, subcutaneous, spinal or other parenteral routes of administration, for example by injection or infusion. The phrase "parenteral administration" as used herein means modes of administration other than enteral and topical administration, usually by injection, and includes, without limitation, intravenous, intramuscular, intraarterial, intrathecal, intracapsular, intraorbital, intracardiac, intradermal, intraperitoneal, transtracheal, subcutaneous, subcuticular, intraarticular, subcapsular, subarachnoid, intraspinal, epidural and intrasternal injection and infusion.

Alternatively, an antibody described herein can be administered via a non-parenteral route, such as a topical, epidermal or mucosal route of administration, for example, intranasally, orally, vaginally, rectally, sublingually or topically.

The active compounds can be prepared with carriers that will protect the compound against rapid release, such as a controlled release formulation, including implants, transdermal patches, and microencapsulated delivery systems. Biodegradable, biocompatible polymers can be used, such as ethylene vinyl acetate, polyanhydrides, polyglycolic acid, collagen, polyorthoesters, and polylactic acid. Many methods for the preparation of such formulations are patented or generally known to those skilled in the art. See, e.g., *Sustained and Controlled Release Drug Delivery Systems*, J. R. Robinson, ed., Marcel Dekker, Inc., New York, 1978.

Therapeutic compositions can be administered with medical devices known in the art. For example, in a preferred embodiment, a therapeutic composition described herein can be administered with a needleless hypodermic injection device, such as the devices disclosed in U.S. Pat. Nos. 5,399,163; 5,383,851; 5,312,335; 5,064,413; 4,941,880; 4,790,824; or 4,596,556. Examples of well-known implants and modules for use with anti-GITR antibodies described herein include: U.S. Pat. No. 4,487,603, which discloses an implantable micro-infusion pump for dispensing medication at a controlled rate; U.S. Pat. No. 4,486,194, which discloses a therapeutic device for administering medicants through the skin; U.S. Pat. No. 4,447,233, which discloses a medication infusion pump for delivering medication at a precise infusion rate; U.S. Pat. No. 4,447,224, which discloses a variable flow implantable infusion apparatus for continuous drug delivery; U.S. Pat. No. 4,439,196, which discloses an osmotic drug delivery system having multi-chamber compartments; and U.S. Pat. No. 4,475,196, which discloses an osmotic drug delivery system. These patents are incorporated herein by reference. Many other such implants, delivery systems, and modules are known to those skilled in the art.

In certain embodiments, the anti-GITR antibodies described herein can be formulated to ensure proper distribution in vivo. For example, the blood-brain barrier (BBB) excludes many highly hydrophilic compounds. To ensure that the therapeutic compounds described herein cross the BBB (if desired, e.g., for brain cancers), they can be formulated, for example, in liposomes. For methods of manufacturing liposomes, see, e.g., U.S. Pat. Nos. 4,522,811; 5,374,548; and 5,399,331. The liposomes may comprise one or more moieties which are selectively transported into specific cells or organs, thus enhance targeted drug delivery (see, e.g., V. V. Ranade (1989) *J. Clin. Pharmacol.* 29:685). Exemplary targeting moieties include folate or biotin (see, e.g., U.S. Pat. No. 5,416,016 to Low et al.); mannosides (Umezawa et al., (1988) *Biochem. Biophys. Res. Commun.* 153:1038); antibodies (P. G. Bloeman et al. (1995) *FEBS Lett.* 357:140; M. Owais et al. (1995) *Antimicrob. Agents Chemother.* 39:180); surfactant protein A receptor (Briscoe et al. (1995) *Am. J. Physiol.* 1233:134); p120 (Schreier et al. (1994) *J. Biol. Chem.* 269:9090); see also K. Keinanen; M. L. Laukkanen (1994) *FEBS Lett.* 346:123; J. J. Killion; I. J. Fidler (1994) *Immunomethods* 4:273.

XVI. Uses and Methods

The antibodies, antibody compositions and methods described herein have numerous in vitro and in vivo utilities involving, for example, enhancement of immune response by activating GITR signaling, or detection of GITR. In a preferred embodiment, the antibodies described herein are human antibodies. For example, anti-GITR antibodies described herein can be administered to cells in culture, in vitro or ex vivo, or to human subjects, e.g., in vivo, to enhance immunity in a variety of diseases. Accordingly, provided herein are methods of modifying an immune response in a subject comprising administering to the subject an antibody, or antigen-binding portion thereof, described herein such that the immune response in the subject is modified. Preferably, the response is enhanced, stimulated or up-regulated.

Preferred subjects include human patients in whom enhancement of an immune response would be desirable. The methods are particularly suitable for treating human patients having a disorder that can be treated by augmenting an immune response (e.g., a T-cell mediated immune response, e.g., an antigen specific T cell response). In a particular embodiment, the methods are particularly suitable for treatment of cancer in vivo. To achieve antigen-specific enhancement of immunity, anti-GITR antibodies described herein can be administered together with an antigen of interest or the antigen may already be present in the subject to be treated (e.g., a tumor-bearing or virus-bearing subject). When antibodies to GITR are administered together with another agent, the two can be administered separately or simultaneously.

Also encompassed are methods for detecting the presence of human GITR antigen in a sample, or measuring the amount of human GITR antigen, comprising contacting the sample, and a control sample, with a monoclonal antibody, e.g., a human monoclonal antibody, or an antigen binding portion thereof, which specifically binds to human GITR, under conditions that allow for formation of a complex between the antibody or portion thereof and human GITR. The formation of a complex is then detected, wherein a difference complex formation between the sample compared to the control sample is indicative the presence of human GITR antigen in the sample. Moreover, the anti-GITR antibodies described herein can be used to purify human GITR via immunoaffinity purification.

Given the ability of anti-GITR antibodies described herein to stimulate or co-stimulate T cell responses, e.g., antigen-specific T cell responses, provided herein are in vitro and in vivo methods of using the antibodies described herein to stimulate, enhance or upregulate antigen-specific T cell responses, e.g., anti-tumor T cell responses. In certain embodiments, CD3 stimulation is also provided (e.g., by coincubation with a cell expressing membrane CD3), which stimulation can be provided at the same time, before, or after stimulation with an anti-GITR antibody. For example, provided herein are methods of stimulating an antigen-specific T cell response comprising contacting said T cell with an anti-GITR antibody described herein, and optionally with an anti-CD3 antibody, such that an antigen-specific T cell response is stimulated. Any suitable indicator of an antigen-specific T cell response can be used to measure the antigen-specific T cell response. Non-limiting examples of such suitable indicators include increased T cell proliferation in the presence of the antibody and/or increase cytokine production in the presence of the antibody. In a preferred embodiment, interleukin-2 and/or interferon-γ production by the antigen-specific T cell is stimulated.

T cells that can be enhanced or co-stimulated with anti-GITR antibodies include CD4+ T cells and CD8+ T cells. The T cells can be $T_{eff}$ cells, e.g., CD4+ $T_{eff}$ cells, CD8+ $T_{eff}$ cells, Thelper ($T_h$) cells and T cytotoxic ($T_c$) cells.

Further encompassed are methods of stimulating an immune response (e.g., an antigen-specific T cell response) in a subject comprising administering an anti-GITR antibody described herein to the subject such that an immune response (e.g., an antigen-specific T cell response) in the subject is stimulated. In a preferred embodiment, the subject is a tumor-bearing subject and an immune response against the tumor is stimulated. A tumor may be a solid tumor or a liquid tumor, e.g., a hematological malignancy. In certain embodiments, a tumor is an immunogenic tumor. In certain embodiments, a tumor is non-immunogenic. In certain embodiments, a tumor is PD-L1 positive. In certain embodiments a tumor is PD-L1 negative. A subject may also be a virus-bearing subject and an immune response against the virus is stimulated.

Further provided are methods for inhibiting growth of tumor cells in a subject comprising administering to the subject an anti-GITR antibody described herein such that growth of the tumor is inhibited in the subject. Also provided are methods of treating viral infection in a subject comprising administering to the subject an anti-GITR antibody described herein such that the viral infection is treated in the subject.

Also encompassed herein are methods for depleting Treg cells from the tumor microenvironment of a subject having a tumor, e.g., cancerous tumor, comprising administering to the subject a therapeutically effective amount of an anti-GITR antibody described herein that comprises an Fc that stimulates depletion of $T_{reg}$ cells in the tumor microenvironment. An Fc may, e.g., be an Fc with effector function or enhanced effector function, such as binding or having enhanced binding to one or more activating Fc receptors. In a preferred embodiment, $T_{reg}$ depletion occurs without significant depletion or inhibition of $T_{eff}$ in the tumor microenvironment, and without significant depletion or inhibition of $T_{eff}$ cells and $T_{reg}$ cells outside of the tumor microenvironment, e.g., in the periphery. In certain embodiments, the subject has higher levels of GITR on $T_{reg}$ cells than on $T_{eff}$ cells, e.g., in the tumor microenvironment.

In certain embodiments, a subject is treated with an anti-GITR antibody having an Fc that enhances agonism, e.g., binds to or has enhanced binding to the inhibitory FcRIIb. Certain treatments are conducted with an anti-GITR antibody having an Fc that does not bind to, or has reduced binding to, one or more activating FcRs. Anti-GITR antibodies may deplete Tregs in tumors and/or Tregs in tumor infiltrating lymphocytes (TILs).

In certain embodiments, an anti-GITR antibody is given to a subject as an adjunctive therapy. Treatments of subjects having cancer with an anti-GITR antibody may lead to prolonged survival, e.g., long-term durable response relative to the current standard of care; long term survival of at least 3 months, 6 months, 9 months, 1, 2, 3, 4, 5, 10 or more years, or recurrence-free survival of at least 3 months, 6 months, 9 months, 1, 2, 3, 4, 5, or 10 or more years. In certain embodiments, treatment of a subject having cancer with an anti-GITR antibody prevents recurrence of cancer or delays recurrence of cancer by, e.g., 3 months, 6 months, 9 months, 1, 2, 3, 4, 5, or 10 or more years. An anti-GITR treatment can be used as a first-, second-, or third-line treatment.

In preferred embodiments, an anti-GITR antibody described herein is not significantly toxic. For example, a GITR antibody is not significantly toxic to an organ of a human, e.g., one or more of the liver, kidney, brain, lungs, and heart, as determined, e.g., in clinical trials. In certain embodiments, a GITR antibody does not significantly trigger an undesirable immune response, e.g., autoimmunity or inflammation.

In certain embodiments, treatment of a subject with an anti-GITR agonist (e.g., an anti-GITR antibody) does not result in overstimulation of the immune system to the extent that the subject's immune system then attacks the subject itself (e.g., autoimmune response) or results in, e.g., anaphylaxis. Thus, anti-GITR antibodies preferably do not cause anaphylaxis.

In certain embodiments, treatment of a subject with an anti-GITR antibody described herein, e.g., an antibody comprising the CDRs or variable regions of 28F3, does not cause significant inflammatory reactions, e.g., immune-mediated pneumonitis, immune-mediated colitis, immune mediated hepatitis, immune-mediated nephritis or renal dysfunction, immune-mediated hypophysitis, immune-mediated hypothyroidism and hyperthyroidism, or other immune-mediated adverse reactions. In certain embodiments, an anti-GITR antibody comprising the CDRs or variable regions of 28F3 causes fewer inflammatory reactions, e.g., immune-mediated pneumonitis, immune-mediated colitis, immune mediated hepatitis, immune-mediated nephritis or renal dysfunction, immune-mediated hypophysitis, immune-mediated hypothyroidism and hyperthyroidism, anaphylaxis or other immune-mediated adverse reactions, than other anti-GITR antibodies. Other immune-mediated adverse reactions include: cardiac disorders, e.g., ventricular arrhythmia; eye disorders, e.g., iridocyclitis; infusion-related reactions; increased amylase, increased lipase; nervous system disorders, e.g., dizziness, peripheral and sensory neuropathy; skin and subcutaneous tissue disorders, e.g., rash, pruritus, exfoliative dermatitis, erythema multiforme, vitiligo or psoriasis; respiratory, thoracic and mediastinal disorders, e.g., cough; fatigue; nausea; decreased appetite; constipation; arthralgia; and diarrhea.

In certain embodiments, a GITR antibody provides synergistic anti-tumor effects in combination with another cancer therapy, such as a compound that stimulates the immune system (e.g., an immune-oncology agent), e.g., a compound described herein or a compound modulating a target described herein.

These and other methods described herein are discussed in further detail below.

Cancer

Activation of GITR by anti-GITR antibodies can enhance the immune response to cancerous cells in the patient. Provided herein are methods for treating a subject having cancer, comprising administering to the subject an anti-GITR antibody described herein, such that the subject is treated, e.g., such that growth of cancerous tumors is inhibited or reduced and/or that the tumors regress and/or that prolonged survival is achieved. An anti-GITR antibody can be used alone to inhibit the growth of cancerous tumors. Alternatively, an anti-GITR antibody can be used in conjunction with another agent, e.g., another immunogenic agent, a standard cancer treatment, or another antibody, as described below.

Accordingly, provided herein are methods of treating cancer, e.g., by inhibiting growth of tumor cells, in a subject, comprising administering to the subject a therapeutically effective amount of an anti-GITR antibody described herein, e.g., 28F3.IgG1 or 28F3.IgG1.1, or antigen-binding portion thereof. The antibody may be a human anti-GITR antibody (such as any of the human anti-human GITR antibodies described herein). Additionally or alternatively, the antibody can be a chimeric or humanized anti-GITR antibody, e.g., a chimeric or humanized anti-GITR antibody comprising sequences of 28F3 or other anti-GITR antibodies described herein.

Cancers whose growth may be inhibited using the antibodies of the invention include cancers typically responsive to immunotherapy and those that are not typically responsive to immunotherapy. Cancers may be cancers with solid tumors or blood malignancies (liquid tumors). Non-limiting examples of cancers for treatment include squamous cell carcinoma, small-cell lung cancer, non-small cell lung cancer, squamous non-small cell lung cancer (NSCLC), non squamous NSCLC, glioma, gastrointestinal cancer, renal cancer (e.g. clear cell carcinoma), ovarian cancer, liver cancer, colorectal cancer, endometrial cancer, kidney cancer (e.g., renal cell carcinoma (RCC)), prostate cancer (e.g. hormone refractory prostate adenocarcinoma), thyroid cancer, neuroblastoma, pancreatic cancer, glioblastoma (glioblastoma multiforme), cervical cancer, stomach cancer, bladder cancer, hepatoma, breast cancer, colon carcinoma, and head and neck cancer (or carcinoma), gastric cancer, germ cell tumor, pediatric sarcoma, sinonasal natural killer, melanoma (e.g., metastatic malignant melanoma, such as cutaneous or intraocular malignant melanoma), bone cancer, skin cancer, uterine cancer, cancer of the anal region, testicular cancer, carcinoma of the fallopian tubes, carcinoma of the endometrium, carcinoma of the cervix, carcinoma of the vagina, carcinoma of the vulva, cancer of the esophagus, cancer of the small intestine, cancer of the endocrine system, cancer of the parathyroid gland, cancer of the adrenal gland, sarcoma of soft tissue, cancer of the urethra, cancer of the penis, solid tumors of childhood, cancer of the ureter, carcinoma of the renal pelvis, neoplasm of the central nervous system (CNS), primary CNS lymphoma, tumor angiogenesis, spinal axis tumor, brain cancer, brain stem glioma, pituitary adenoma, Kaposi's sarcoma, epidermoid cancer, squamous cell cancer, T-cell lymphoma, environmentally-induced cancers including those induced by asbestos, virus-related cancers or cancers of viral origin (e.g., human papilloma virus (HPV-related or -originating tumors)), and hematologic malignancies derived from either of the two major blood cell lineages, i.e., the myeloid cell line (which produces granulocytes, erythrocytes, thrombocytes, macrophages and mast cells) or lymphoid cell line (which produces B, T, NK and plasma cells), such as all types of leukemias, lymphomas, and myelomas, e.g., acute, chronic, lymphocytic and/or myelogenous leukemias, such as acute leukemia (ALL), acute myelogenous leukemia (AML), chronic lymphocytic leukemia (CLL), and chronic myelogenous leukemia (CML), undifferentiated AML (M0), myeloblastic leukemia (M1), myeloblastic leukemia (M2; with cell maturation), promyelocytic leukemia (M3 or M3 variant [M3V]), myelomonocytic leukemia (M4 or M4 variant with eosinophilia [M4E]), monocytic leukemia (M5), erythroleukemia (M6), megakaryoblastic leukemia (M7), isolated granulocytic sarcoma, and chloroma; lymphomas, such as Hodgkin's lymphoma (HL), non-Hodgkin's lymphoma (NHL), B cell hematologic malignancy, e.g., B-cell lymphomas, T-cell lymphomas, lymphoplasmacytoid lymphoma, monocytoid B-cell lymphoma, mucosa-associated lymphoid tissue (MALT) lymphoma, anaplastic (e.g., Ki 1+) large-cell lymphoma, adult T-cell lymphoma/leukemia, mantle cell lymphoma, angio immunoblastic T-cell lymphoma, angiocentric lymphoma, intestinal T-cell lymphoma, primary mediastinal B-cell lymphoma, precursor T-lymphoblastic lymphoma, T-lymphoblastic; and lymphoma/leukaemia (T-Lbly/T-ALL), peripheral T-cell lymphoma, lymphoblastic lymphoma, post-transplantation lymphoproliferative disorder, true histiocytic lymphoma, primary central nervous system lymphoma, primary effusion lymphoma, B cell lymphoma, lymphoblastic lymphoma (LBL), hematopoietic tumors of lymphoid lineage, acute lymphoblastic leukemia, diffuse large B-cell lymphoma, Burkitt's lymphoma, follicular lymphoma, diffuse histiocytic lymphoma (DHL), immunoblastic large cell lymphoma, precursor B-lymphoblastic lymphoma, cutaneous T-cell lymphoma (CTLC) (also called mycosis fungoides or Sezary syndrome), and lymphoplasmacytoid lymphoma (LPL) with Waldenstrom's macroglobulinemia; myelomas, such as IgG myeloma, light chain myeloma, nonsecretory myeloma, smoldering myeloma (also called indolent myeloma), solitary plasmocytoma, and multiple myelomas, chronic lymphocytic leukemia (CLL), hairy cell lymphoma; hematopoietic tumors of myeloid lineage, tumors of mesenchymal origin, including fibrosarcoma and rhabdomyoscarcoma; seminoma, teratocarcinoma, tumors of the central and peripheral nervous, including astrocytoma, schwannomas; tumors of mesenchymal origin, including fibrosarcoma, rhabdomyscaroma, and osteosarcoma; and other tumors, including melanoma, xeroderma pigmentosum, keratoacanthoma, seminoma, thyroid follicular cancer and teratocarcinoma, hematopoietic tumors of lymphoid lineage, for example T-cell and B-cell tumors, including but not limited to T-cell disorders such as T-prolymphocytic leukemia (T-PLL), including of the small cell and cerebriform cell type; large granular lymphocyte leukemia (LGL) preferably of the T-cell type; a/d T-NHL hepatosplenic lymphoma; peripheral/post-thymic T cell lymphoma (pleomorphic and immunoblastic subtypes); angiocentric (nasal) T-cell lymphoma; cancer of the head or neck, renal cancer, rectal cancer, cancer of the thyroid gland; acute myeloid lymphoma, as well as any combinations of said cancers. The methods described herein may also be used for treatment of metastatic cancers, unresectable and/or refractory cancers (e.g., cancers refractory to previous immunotherapy, e.g., with a blocking CTLA-4 or PD-1 or PD-L1 antibody), and recurrent cancers.

In certain embodiments, an anti-GITR Ab is administered to patients having a cancer that exhibited an inadequate response to a prior treatment, e.g., a prior treatment with an immuno-oncology drug, or patients having a cancer that is refractory or resistant, either intrinsically refractory or resistant (e.g., refractory to a PD-1 pathway antagonist), or a wherein the resistance or refractory state is acquired. For example, subjects who are not responsive or not sufficiently responsive to a first therapy or who see disease progression following treatment, e.g., anti-PD-1 treatment, may be treated by administration of an anti-GITR antibody alone or in combination with another therapy (e.g., with an anti-PD-1 therapy).

In certain embodiments, an anti-GITR antibody is administered to patients who have not previously received (i.e., been treated with) an immuno-oncology agent, e.g., a PD-1 pathway antagonist.

An anti-GITR antibody may be administered with a standard of care treatment. An anti-GITR antibody may be administered as a maintenance therapy, e.g., a therapy that is intended to prevent the occurrence or recurrence of tumors.

An anti-GITR antibody may be administered with another treatment, e.g., radiation, surgery, or chemotherapy. For example, anti-GITR antibody adjunctive therapy may be administered when there is a risk that micrometastases may be present and/or in order to reduce the risk of a relapse.

An anti-GITR antibody can be administered as a monotherapy, or as the only immunostimulating therapy. Antibodies to GITR, e.g., the anti-GITR antibodies described herein, can also be combined with an immunogenic agent, such as cancerous cells, purified tumor antigens (including recombinant proteins, peptides, and carbohydrate molecules), cells, and cells transfected with genes encoding immune stimulating cytokines (He et al (2004) *J. Immunol.* 173:4919-28). Non-limiting examples of tumor vaccines that can be used include peptides of melanoma antigens, such as peptides of gp100, MAGE antigens, Trp-2, MART1 and/or tyrosinase, or tumor cells transfected to express the cytokine GM-CSF (discussed further below).

In humans, some tumors have been shown to be immunogenic such as melanomas. By lowereing the threshold of T cell activation via GITR activation, the tumor responses in the host can be activated, allowing treatment of non-immunogenic tumors or those having limited immunogenicity.

An anti-GITR antibody, e.g., an anti-GITR antibody described herein, may be combined with a vaccination protocol. Many experimental strategies for vaccination against tumors have been devised (see Rosenberg, S., 2000, Development of Cancer Vaccines, ASCO Educational Book Spring: 60-62; Logothetis, C., 2000, ASCO Educational Book Spring: 300-302; Khayat, D. 2000, ASCO Educational Book Spring: 414-428; Foon, K. 2000, ASCO Educational Book Spring: 730-738; see also Restifo, N. and Sznol, M., Cancer Vaccines, Ch. 61, pp. 3023-3043 in DeVita et al. (eds.), 1997, Cancer: Principles and Practice of Oncology, Fifth Edition). In one of these strategies, a vaccine is prepared using autologous or allogeneic tumor cells. These cellular vaccines have been shown to be most effective when the tumor cells are transduced to express GM-CSF. GM-CSF has been shown to be a potent activator of antigen presentation for tumor vaccination (Dranoff et al. (1993) *Proc. Natl. Acad. Sci U.S.A.* 90: 3539-43).

The study of gene expression and large scale gene expression patterns in various tumors has led to the definition of so called tumor specific antigens (Rosenberg, S A (1999) *Immunity* 10: 281-7). In many cases, these tumor specific antigens are differentiation antigens expressed in the tumors and in the cell from which the tumor arose, for example melanocyte antigens gp100, MAGE antigens, and Trp-2. More importantly, many of these antigens can be shown to be the targets of tumor specific T cells found in the host. GITR activation can be used in conjunction with a collection of recombinant proteins and/or peptides expressed in a tumor in order to generate an immune response to these proteins. These proteins are normally viewed by the immune system as self antigens and are therefore tolerant to them. The tumor antigen can include the protein telomerase, which is required for the synthesis of telomeres of chromosomes and which is expressed in more than 85% of human cancers and in only a limited number of somatic tissues (Kim et al.

(1994) *Science* 266: 2011-2013). Tumor antigen can also be "neo-antigens" expressed in cancer cells because of somatic mutations that alter protein sequence or create fusion proteins between two unrelated sequences (i.e., bcr-abl in the Philadelphia chromosome), or idiotype from B cell tumors.

Other tumor vaccines can include the proteins from viruses implicated in human cancers such a Human Papilloma Viruses (HPV), Hepatitis Viruses (HBV and HCV) and Kaposi's Herpes Sarcoma Virus (KHSV). Another form of tumor specific antigen which can be used in conjunction with GITR activation is purified heat shock proteins (HSP) isolated from the tumor tissue itself. These heat shock proteins contain fragments of proteins from the tumor cells and these HSPs are highly efficient at delivery to antigen presenting cells for eliciting tumor immunity (Suot & Srivastava (1995) *Science* 269:1585-1588; Tamura et al. (1997) *Science* 278:117-120).

Dendritic cells (DC) are potent antigen presenting cells that can be used to prime antigen-specific responses. DC's can be produced ex vivo and loaded with various protein and peptide antigens as well as tumor cell extracts (Nestle et al. (1998) *Nature Medicine* 4: 328-332). DCs can also be transduced by genetic means to express these tumor antigens as well. DCs have also been fused directly to tumor cells for the purposes of immunization (Kugler et al. (2000) *Nature Medicine* 6:332-336). As a method of vaccination, DC immunization can be effectively combined with GITR activation to activate more potent anti-tumor responses.

GITR activation can also be combined with standard cancer treatments (e.g., surgery, radiation, and chemotherapy). GITR activation can be effectively combined with chemotherapeutic regimes. In these instances, it may be possible to reduce the dose of chemotherapeutic reagent administered (Mokyr et al. (1998) *Cancer Research* 58: 5301-5304). An example of such a combination is an anti-GITR antibody in combination with decarbazine for the treatment of melanoma. Another example of such a combination is an anti-GITR antibody in combination with interleukin-2 (IL-2) for the treatment of melanoma. The scientific rationale behind the combined use of GITR activation and chemotherapy is that cell death, that is a consequence of the cytotoxic action of most chemotherapeutic compounds, should result in increased levels of tumor antigen in the antigen presentation pathway. Other combination therapies that may result in synergy with GITR activation through cell death are radiation, surgery, and hormone deprivation. Each of these protocols creates a source of tumor antigen in the host. Angiogenesis inhibitors can also be combined with GITR activation. Inhibition of angiogenesis leads to tumor cell death which may feed tumor antigen into host antigen presentation pathways.

The anti-GITR antibodies described herein can also be used in combination with bispecific antibodies that target Fcα or Fcγ receptor-expressing effectors cells to tumor cells (see, e.g., U.S. Pat. Nos. 5,922,845 and 5,837,243). Bispecific antibodies can be used to target two separate antigens. For example anti-Fc receptor/anti tumor antigen (e.g., Her-2/neu) bispecific antibodies have been used to target macrophages to sites of tumor. This targeting may more effectively activate tumor specific responses. The T cell arm of these responses would be augmented by the activation of GITR. Alternatively, antigen may be delivered directly to DCs by the use of bispecific antibodies which bind to tumor antigen and a dendritic cell specific cell surface marker.

Tumors evade host immune surveillance by a large variety of mechanisms. Many of these mechanisms may be overcome by the inactivation of proteins which are expressed by the tumors and which are immunosuppressive. These include among others TGF-β (Kehrl et al. (1986) *J. Exp. Med.* 163: 1037-1050), IL-10 (Howard & O'Garra (1992) *Immunology Today* 13: 198-200), and Fas ligand (Hahne et al. (1996) *Science* 274: 1363-1365). Antibodies to each of these entities can be used in combination with anti-GITR antibodies to counteract the effects of the immunosuppressive agent and favor tumor immune responses by the host.

Other antibodies which activate host immune responsiveness can be used in combination with anti-GITR antibodies. These include molecules on the surface of dendritic cells which activate DC function and antigen presentation. Anti-CD40 antibodies are able to substitute effectively for T cell helper activity (Ridge et al. (1998) *Nature* 393: 474-478) and can be used in conjunction with anti-GITR antibodies. Activating antibodies to T cell costimulatory molecules such as CTLA-4 (e.g., U.S. Pat. No. 5,811,097), OX-40 (Weinberg et al. (2000) *Immunol* 164: 2160-2169), 4-1BB (Melero et al. (1997) *Nature Medicine* 3: 682-685 (1997), and ICOS (Hutloff et al. (1999) *Nature* 397: 262-266) may also provide for increased levels of T cell activation. Inhibitors of PD1 or PD-L1 may also be used in conjunction with an anti-GITR antibody.

Bone marrow transplantation is currently being used to treat a variety of tumors of hematopoietic origin. While graft versus host disease is a consequence of this treatment, therapeutic benefit may be obtained from graft vs. tumor responses. GITR activation can be used to increase the effectiveness of the donor engrafted tumor specific T cells.

There are also several experimental treatment protocols that involve ex vivo activation and expansion of antigen specific T cells and adoptive transfer of these cells into recipients in order to stimulate antigen-specific T cells against tumor (Greenberg & Riddell (1999) *Science* 285: 546-51). These methods can also be used to activate T cell responses to infectious agents such as CMV. Ex vivo activation in the presence of anti-GITR antibodies can increase the frequency and activity of the adoptively transferred T cells.

Infectious Diseases

Methods described herein may also be used to treat patients that have been exposed to particular toxins or pathogens. Accordingly, another aspect described herein provides a method of treating an infectious disease in a subject comprising administering to the subject an anti-GITR antibody, or antigen-binding portion thereof, such that the subject is treated for the infectious disease. Additionally or alternatively, the antibody can be a chimeric or humanized antibody.

Similar to its application to tumors as discussed above, antibody-mediated GITR activation can be used alone, or as an adjuvant, in combination with vaccines, to stimulate the immune response to pathogens, toxins, and self-antigens. Examples of pathogens for which this therapeutic approach can be particularly useful, include pathogens for which there is currently no effective vaccine, or pathogens for which conventional vaccines are less than completely effective. These include, but are not limited to HIV, Hepatitis (A, B, & C), Influenza, Herpes, Giardia, Malaria, Leishmania, *Staphylococcus aureus, Pseudomonas aeruginosa*. GITR activation may be useful against established infections by agents such as HIV that present altered antigens over the course of the infections. These novel epitopes are recognized as foreign at the time of anti-human GITR antibody administration, thus provoking a strong T cell response.

Some examples of pathogenic viruses causing infections treatable by methods described herein include HIV, hepatitis (A, B, or C), herpes virus (e.g., VZV, HSV-1, HAV-6, HSV-II, and CMV, Epstein Barr virus), adenovirus, influenza virus, flaviviruses, echovirus, rhinovirus, coxsackie virus, coronavirus, respiratory syncytial virus, mumps virus, rotavirus, measles virus, rubella virus, parvovirus, vaccinia virus, HTLV virus, dengue virus, papillomavirus, molluscum virus, poliovirus, rabies virus, JC virus and arboviral encephalitis virus.

Some examples of pathogenic bacteria causing infections treatable by methods described herein include chlamydia, rickettsial bacteria, mycobacteria, staphylococci, streptococci, pneumonococci, meningococci and gonococci, klebsiella, proteus, serratia, pseudomonas, legionella, diphtheria, salmonella, bacilli, cholera, tetanus, botulism, anthrax, plague, leptospirosis, and Lymes disease bacteria.

Some examples of pathogenic fungi causing infections treatable by methods described herein include *Candida* (*albicans, krusei, glabrata, tropicalis*, etc.), *Cryptococcus neoformans, Aspergillus* (*fumigatus, niger*, etc.), Genus Mucorales (*mucor, absidia, rhizopus*), *Sporothrix schenkii, Blastomyces dermatitidis, Paracoccidioides brasiliensis, Coccidioides immitis* and *Histoplasma capsulatum*.

Some examples of pathogenic parasites causing infections treatable by methods described herein include *Entamoeba histolytica, Balantidium coli, Naegleriafowleri, Acanthamoeba* sp., *Giardia lambia, Cryptosporidium* sp., *Pneumocystis carinii, Plasmodium vivax, Babesia microti, Trypanosoma brucei, Trypanosoma cruzi, Leishmania donovani, Toxoplasma gondii, Nippostrongylus brasiliensis*.

In all of the above methods, GITR activation can be combined with other forms of immunotherapy such as cytokine treatment (e.g., interferons, GM-CSF, G-CSF, IL-2), or bispecific antibody therapy, which provides for enhanced presentation of tumor antigens (see, e.g., Holliger (1993) *Proc. Natl. Acad. Sci. USA* 90:6444-6448; Poljak (1994) *Structure* 2:1121-1123).

Autoimmune Reactions

Anti-GITR antibodies may provoke and amplify autoimmune responses. Indeed, induction of anti-tumor responses using tumor cell and peptide vaccines reveals that many anti-tumor responses involve anti-self reactivities (van Elsas et al. (2001) *J. Exp. Med.* 194:481-489; Overwijk, et al. (1999) *Proc. Natl. Acad. Sci. U.S.A.* 96: 2982-2987; Hurwitz, (2000) supra; Rosenberg & White (1996) *J. Immunother Emphasis Tumor Immunol* 19 (1): 81-4). Therefore, it is possible to consider using anti-GITR antibodies in conjunction with various self proteins in order to devise vaccination protocols to efficiently generate immune responses against these self proteins for disease treatment. For example, Alzheimer's disease involves inappropriate accumulation of Aβ peptide in amyloid deposits in the brain; antibody responses against amyloid are able to clear these amyloid deposits (Schenk et al., (1999) *Nature* 400: 173-177).

Other self proteins can also be used as targets such as IgE for the treatment of allergy and asthma, and TNFc for rheumatoid arthritis. Finally, antibody responses to various hormones may be induced by the use of anti-GITR antibodies. Neutralizing antibody responses to reproductive hormones can be used for contraception. Neutralizing antibody response to hormones and other soluble factors that are required for the growth of particular tumors can also be considered as possible vaccination targets.

Analogous methods as described above for the use of anti-GITR antibodies can be used for induction of therapeutic autoimmune responses to treat patients having an inappropriate accumulation of other self-antigens, such as amyloid deposits, including Aβ in Alzheimer's disease, cytokines such as TNFα, and IgE.

Vaccines

Anti-GITR antibodies described herein can be used to stimulate antigen-specific immune responses by coadministration of an anti-GITR antibody with an antigen of interest (e.g., a vaccine). Accordingly, provided herein are methods of enhancing an immune response to an antigen in a subject, comprising administering to the subject: (i) the antigen; and (ii) an anti-GITR antibody, or antigen-binding portion thereof, such that an immune response to the antigen in the subject is enhanced. The antibody may be a human anti-human GITR antibody (such as any of the human anti-GITR antibodies described herein). Additionally or alternatively, the antibody can be a chimeric or humanized antibody. The antigen can be, for example, a tumor antigen, a viral antigen, a bacterial antigen or an antigen from a pathogen. Non-limiting examples of such antigens include those discussed in the sections above, such as the tumor antigens (or tumor vaccines) discussed above, or antigens from the viruses, bacteria or other pathogens described above.

In certain embodiments, a peptide or fusion protein comprising the epitope to which an anti-GITR antibody binds is used as a vaccine instead of, or in addition to, an anti-GITR antibody.

Suitable routes of administering the antibody compositions (e.g., human monoclonal antibodies, multispecific and bispecific molecules and immunoconjugates) described herein in vivo and in vitro are well known in the art and can be selected by those of ordinary skill. For example, the antibody compositions can be administered by injection (e.g., intravenous or subcutaneous). Suitable dosages of the molecules used will depend on the age and weight of the subject and the concentration and/or formulation of the antibody composition.

As previously described, anti-GITR antibodies described herein can be co-administered with one or other more therapeutic agents, e.g., a cytotoxic agent, a radiotoxic agent or an immunosuppressive agent. The antibody can be linked to the agent (as an immuno-complex) or can be administered separate from the agent. In the latter case (separate administration), the antibody can be administered before, after or concurrently with the agent or can be co-administered with other known therapies, e.g., an anti-cancer therapy, e.g., radiation. Such therapeutic agents include, among others, anti-neoplastic agents such as doxorubicin (adriamycin), cisplatin bleomycin sulfate, carmustine, chlorambucil, dacarbazine and cyclophosphamide hydroxyurea which, by themselves, are only effective at levels which are toxic or subtoxic to a patient. Cisplatin is intravenously administered as a 100 mg/ml dose once every four weeks and adriamycin is intravenously administered as a 60-75 mg/ml dose once every 21 days. Co-administration of anti-GITR antibodies, or antigen binding fragments thereof, described herein with chemotherapeutic agents provides two anti-cancer agents which operate via different mechanisms which yield a cytotoxic effect to human tumor cells. Such co-administration can solve problems due to development of resistance to drugs or a change in the antigenicity of the tumor cells which would render them unreactive with the antibody.

Also within the scope described herein are kits comprising the antibody compositions described herein (e.g., human antibodies, bispecific or multispecific molecules, or immunoconjugates) and instructions for use. The kit can further contain at least one additional reagent, or one or more additional human antibodies described herein (e.g., a human antibody having a complementary activity which binds to an epitope in GITR antigen distinct from the first human antibody). Kits typically include a label indicating the intended use of the contents of the kit. The term label includes any writing, or recorded material supplied on or with the kit, or which otherwise accompanies the kit.

Combination Therapies

In addition to the combinations therapies provided above, anti-GITR antibodies, e.g., those described herein, can also be used in combination therapy, e.g., for treating cancer, as described below.

Provided herein are methods of combination therapy in which an anti-GITR antibody is coadministered with one or more additional agents, e.g., small molecule drugs, antibodies or antigen binding portions thereof, that are effective in stimulating immune responses to thereby further enhance, stimulate or upregulate immune responses in a subject. As shown in the Examples, the administration of an agonist anti-GITR antibody and an antagonist anti-PD-1 antibody to mice had a synergic effect in inhibiting tumor growth.

Generally, an anti-GITR antibody, e.g., described herein, can be combined with (i) an agonist of a stimulatory (e.g., co-stimulatory) molecule (e.g., receptor or ligand) and/or (ii) an antagonist of an inhibitory signal or molecule (e.g., receptor or ligand) on immune cells, such as T cells, both of which result in amplifying immune responses, such as antigen-specific T cell responses. In certain aspects, an immuno-oncology agent is (i) an agonist of a stimulatory (including a co-stimulatory) molecule (e.g., receptor or ligand) or (ii) an antagonist of an inhibitory (including a co-inhibitory) molecule (e.g., receptor or ligand) on cells involved in innate immunity, e.g., NK cells, and wherein the immuno-oncology agent enhances innate immunity. Such immuno-oncology agents are often referred to as immune checkpoint regulators, e.g., immune checkpoint inhibitor or immune checkpoint stimulator.

In certain embodiments, an anti-GITR antibody is administered with an agent that targets a stimulatory or inhibitory molecule that is a member of the immunoglobulin super family (IgSF). For example, anti-GITR antibodies, e.g., described herein, may be administered to a subject with an agent that targets a member of the IgSF family to increase an immune response. For example, an anti-GITR antibody may be administered with an agent that targets (or binds specifically to) a member of the B7 family of membrane-bound ligands that includes B7-1, B7-2, B7-H1 (PD-L1), B7-DC (PD-L2), B7-H2 (ICOS-L), B7-H3, B7-H4, B7-H5 (VISTA), and B7-H6 or a co-stimulatory or co-inhibitory receptor binding specifically to a B7 family member.

An anti-GITR antibody may also be administered with an agent that targets a member of the TNF and TNFR family of molecules (ligands or receptors), such as CD40 and CD40L, OX-40, OX-40L, CD70, CD27L, CD30, CD30L, 4-1BBL, CD137, TRAIL/Apo2-L, TRAILR1/DR4, TRAILR2/DR5, TRAILR3, TRAILR4, OPG, RANK, RANKL, TWEAKR/Fn14, TWEAK, BAFFR, EDAR, XEDAR, TACI, APRIL, BCMA, LT(3R, LIGHT, DcR3, HVEM, VEGI/TL1A, TRAMP/DR3, EDA1, EDA2, TNFR1, Lymphotoxin α/TNFβ, TNFR2, TNFα, LTβR, Lymphotoxin α 1β2, FAS, FASL, RELT, DR6, TROY, and NGFR (see, e.g., Tansey (2009) Drug Discovery Today 00:1).

T cell responses can be stimulated by a combination of anti-GITR antibodies described herein, e.g., 28F3.IgG1 and 28F3.IgG1.1, and one or more of the following agents:
(1) An antagonist (inhibitor or blocking agent) of a protein that inhibits T cell activation (e.g., immune checkpoint inhibitors), such as CTLA-4, PD-1, PD-L1, PD-L2, and LAG-3, as described above, and any of the following proteins: TIM-3, Galectin 9, CEACAM-1, BTLA, CD69, Galectin-1, TIGIT, CD113, GPR56, VISTA, B7-H3, B7-H4, 2B4, CD48, GARP, PD1H, LAIR1, TIM-1, and TIM-4; and/or
(2) An agonist of a protein that stimulates T cell activation, such as B7-1, B7-2, CD28, 4-1BB (CD137), 4-1BBL, ICOS, ICOS-L, OX40, OX40L, CD70, CD27, CD40, DR3 and CD28H.

Exemplary agents that modulate one of the above proteins and may be combined with agonist anti-GITR antibodies, e.g., those described herein, for treating cancer, include: Yervoy™ (ipilimumab) or Tremelimumab (to CTLA-4), galiximab (to B7.1), BMS-936558 (to PD-1), MK-3475 (to PD-1), AMP224 (to B7DC), BMS-936559 (to B7-H1), MPDL3280A (to B7-H1), MEDI-570 (to ICOS), AMG557 (to B7H2), MGA271 (to B7H3), IMP321 (to LAG-3), BMS-663513 (to CD137), PF-05082566 (to CD137), CDX-1127 (to CD27), anti-OX40 (Providence Health Services), huMAbOX40L (to OX40L), Atacicept (to TACI), CP-870893 (to CD40), Lucatumumab (to CD40), Dacetuzumab (to CD40), Muromonab-CD3 (to CD3), Ipilumumab (to CTLA-4).

Anti-GITR antibodies may also be administered with pidilizumab (CT-011), although its specificity for PD-1 binding has been questioned.

Other molecules that can be combined with agonist anti-GITR antibodies for the treatment of cancer include antagonists of inhibitory receptors on NK cells or agonists of activating receptors on NK cells. For example, anti-GITR agonist antibodies can be combined with antagonists of KIR (e.g., lirilumab).

T cell activation is also regulated by soluble cytokines, and anti-GITR antibodies may be administered to a subject, e.g., having cancer, with antagonists of cytokines that inhibit T cell activation or agonists of cytokines that stimulate T cell activation.

In certain embodiments, anti-GITR antibodies can be used in combination with (i) antagonists (or inhibitors or blocking agents) of proteins of the IgSF family or B7 family or the TNF family that inhibit T cell activation or antagonists of cytokines that inhibit T cell activation (e.g., IL-6, IL-10, TGF-ß, VEGF; "immunosuppressive cytokines") and/or (ii) agonists of stimulatory receptors of the IgSF family, B7 family or the TNF family or of cytokines that stimulate T cell activation, for stimulating an immune response, e.g., for treating proliferative diseases, such as cancer.

Yet other agents for combination therapies include agents that inhibit or deplete macrophages or monocytes, including but not limited to CSF-1R antagonists such as CSF-1R antagonist antibodies including RG7155 (WO11/70024, WO11/107553, WO11/131407, WO13/87699, WO13/119716, WO13/132044) or FPA-008 (WO11/140249; WO13169264; WO14/036357).

Anti-GITR antibodies may also be administered with agents that inhibit TGF-β signaling.

Additional agents that may be combined with an anti-GITR antibody include agents that enhance tumor antigen presentation, e.g., dendritic cell vaccines, GM-CSF secreting cellular vaccines, CpG oligonucleotides, and imiquimod, or therapies that enhance the immunogenicity of tumor cells (e.g., anthracyclines).

Yet other therapies that may be combined with an anti-GITR antibody include therapies that deplete or block Treg cells, e.g., an agent that specifically binds to CD25.

Another therapy that may be combined with an anti-GITR antibody is a therapy that inhibits a metabolic enzyme such as indoleamine dioxigenase (IDO), dioxigenase, arginase, or nitric oxide synthetase.

Another class of agents that may be used with an anti-GITR antibody includes agents that inhibit the formation of adenosine or inhibit the adenosine A2A receptor.

Other therapies that may be combined with an anti-GITR antibody for treating cancer include therapies that reverse/prevent T cell anergy or exhaustion and therapies that trigger an innate immune activation and/or inflammation at a tumor site.

An anti-GITR antibody may be combined with more than one immuno-oncology agent, and may be, e.g., combined with a combinatorial approach that targets multiple elements of the immune pathway, such as one or more of the following: a therapy that enhances tumor antigen presentation (e.g., dendritic cell vaccine, GM-CSF secreting cellular vaccines, CpG oligonucleotides, imiquimod); a therapy that inhibits negative immune regulation e.g., by inhibiting CTLA-4 and/or PD1/PD-L1/PD-L2 pathway and/or depleting or blocking Tregs or other immune suppressing cells; a therapy that stimulates positive immune regulation, e.g., with agonists that stimulate the CD-137, OX-40, and/or GITR pathway and/or stimulate T cell effector function; a therapy that increases systemically the frequency of anti-tumor T cells; a therapy that depletes or inhibits Tregs, such as Tregs in the tumor, e.g., using an antagonist of CD25 (e.g., daclizumab) or by ex vivo anti-CD25 bead depletion; a therapy that impacts the function of suppressor myeloid cells in the tumor; a therapy that enhances immunogenicity of tumor cells (e.g., anthracyclines); adoptive T cell or NK cell transfer including genetically modified cells, e.g., cells modified by chimeric antigen receptors (CAR-T therapy); a therapy that inhibits a metabolic enzyme such as indoleamine dioxigenase (IDO), dioxigenase, arginase, or nitric oxide synthetase; a therapy that reverses/prevents T cell anergy or exhaustion; a therapy that triggers an innate immune activation and/or inflammation at a tumor site; administration of immune stimulatory cytokines; or blocking of immuno repressive cytokines.

Agonist anti-GITR antibodies described herein can be used together with one or more of agonistic agents that ligate positive costimulatory receptors, blocking agents that attenuate signaling through inhibitory receptors, antagonists, and one or more agents that increase systemically the frequency of anti-tumor T cells, agents that overcome distinct immune suppressive pathways within the tumor microenvironment (e.g., block inhibitory receptor engagement (e.g., PD-L1/PD-1 interactions), deplete or inhibit Tregs (e.g., using an anti-CD25 monoclonal antibody (e.g., daclizumab) or by ex vivo anti-CD25 bead depletion), inhibit metabolic enzymes such as IDO, or reverse/prevent T cell anergy or exhaustion) and agents that trigger innate immune activation and/or inflammation at tumor sites.

In certain embodiments, an anti-GITR antibody is administered to a subject together with a BRAF inhibitor if the subject is BRAF V600 mutation positive.

In certain embodiments, the anti-GITR antibody that is administered together with another immunostimulatory antibody is an antibody described herein. In certain embodiments, the anti-GITR antibody that is administered together with another immunostimulatory antibody is an antibody having the CDR sequences of 6C8, e.g., a humanized antibody having the CDRs of 6C8, as described, e.g., in WO2006/105021; an antibody comprising the CDRs of an anti-GITR antibody described in WO2011/028683; an antibody comprising the CDRs of an anti-GITR antibody described in JP2008278814, an antibody comprising the CDRs of an anti-GITR antibody described in WO2015/031667, or other anti-GITR antibody described or referred to herein.

Provided herein are methods for stimulating an immune response in a subject comprising administering to the subject an agonist anti-GITR molecule, e.g., an antibody, and one or more additional immunostimulatory antibodies, such as an anti-PD-1 antagonist, e.g., antagonist antibody, an anti-PD-L1 antagonist, e.g., antagonist antibody, an antagonist anti-CTLA-4 antagonist, e.g., antagonist antibody and/or an anti-LAG3 antagonist, e.g., an antagonist antibody, such that an immune response is stimulated in the subject, for example to inhibit tumor growth or to stimulate an anti-viral response. In one embodiment, the subject is administered an agonist anti-GITR antibody and an antagonist anti-PD-1 antibody. In one embodiment, the subject is administered an agonist anti-GITR antibody and an antagonist anti-PD-L1 antibody. In one embodiment, the subject is administered an agonist anti-GITR antibody and an antagonist anti-CTLA-4 antibody. In one embodiment, the anti-GITR antibody is a human antibody, such as an antibody described herein. Alternatively, the anti-GITR antibody can be, for example, a chimeric or humanized antibody (e.g., prepared from a mouse anti-GITR mAb), such as those further described herein. In one embodiment, the at least one additional immunostimulatory antibody (e.g., an antagonist anti-PD-1, an antagonist anti-PD-L1, an antagonist anti-CTLA-4 and/or an antagonist anti-LAG3 antibody) is a human antibody. Alternatively, the at least one additional immunostimulatory antibody can be, for example, a chimeric or humanized antibody (e.g., prepared from a mouse anti-PD-1, anti-PD-L1, anti-CTLA-4 and/or anti-LAG3 antibody).

Provided herein are methods for treating a hyperproliferative disease (e.g., cancer), comprising administering an agonist anti-GITR antibody and an antagonist PD-1 antibody to a subject. In certain embodiments, the anti-GITR antibody is administered at a subtherapeutic dose, the anti-PD-1 antibody is administered at a subtherapeutic dose, or both are administered at a subtherapeutic dose. Also provided herein are methods for altering an adverse event associated with treatment of a hyperproliferative disease with an immunostimulatory agent, comprising administering an anti-GITR antibody and a subtherapeutic dose of anti-PD-1 antibody to a subject. In certain embodiments, the subject is human. In certain embodiments, the anti-PD-1 antibody is a human sequence monoclonal antibody and the anti-GITR antibody is human sequence monoclonal antibody, such as an antibody comprising the CDRs or variable regions of 28F3, 19D3, 18E10, 3C3-1, 3C3-2, 2G6, 8A6, 9G7-1, 9G7-2, 14E3, 19H8-1, 19H8-2, and 6G10 described herein (e.g., 28F3.IgG1 or 28F3.IgG1.1) or another agonist anti-GITR antibody described herein.

Suitable PD-1 antagonists for use in the methods described herein, include, without limitation, ligands, antibodies (e.g., monoclonal antibodies and bispecific antibodies), and multivalent agents. In one embodiment, the PD-1 antagonist is a fusion protein, e.g., an Fc fusion protein, such as AMP-244. In one embodiment, the PD-1 antagonist is an anti-PD-1 or anti-PD-L1 antibody.

An exemplary anti-PD-1 antibody is nivolumab (BMS-936558) or an antibody that comprises the CDRs or variable regions of one of antibodies 17D8, 2D3, 4H1, 5C4, 7D3, 5F4 and 4A11 described in WO 2006/121168. In certain embodiments, an anti-PD1 antibody is MK-3475 (Lambrolizumab) described in WO2012/145493; and AMP-514 described in WO 2012/145493. Further known PD-1 antibodies and other PD-1 inhibitors include those described in WO 2009/014708, WO 03/099196, WO 2009/114335, WO 2011/066389, WO 2011/161699, WO 2012/145493, U.S. Pat. Nos. 7,635,757 and 8,217,149, and U.S. Patent Publication No. 2009/0317368. Any of the anti-PD-1 antibodies disclosed in WO2013/173223 may also be used. An anti-PD-1 antibody that competes for binding with, and/or binds to the same epitope on PD-1 as, as one of these antibodies may also be used in combination treatments. Another approach to target the PD-1 receptor is the recombinant protein composed of the extracellular domain of PD-L2 (B7-DC) fused to the Fc portion of IgG1, called AMP-224.

In certain embodiments, the anti-PD-1 antibody binds to human PD-1 with a $K_D$ of $5\times10^{-8}$M or less, binds to human PD-1 with a $K_D$ of $1\times10^{-8}$M or less, binds to human PD-1 with a $K_D$ of $5\times10^{-9}$M or less, or binds to human PD-1 with a $K_D$ of between $1\times10^{-8}$M and $1\times10^{-10}$ M or less.

Provided herein are methods for treating a hyperproliferative disease (e.g., cancer), comprising administering an agonist anti-GITR antibody and an antagonist PD-L1 antibody to a subject. In certain embodiments, the anti-GITR antibody is administered at a subtherapeutic dose, the anti-PD-L1 antibody is administered at a subtherapeutic dose, or both are administered at a subtherapeutic dose. Provided herein are methods for altering an adverse event associated with treatment of a hyperproliferative disease with an immunostimulatory agent, comprising administering an anti-GITR antibody and a subtherapeutic dose of anti-PD-L1 antibody to a subject. In certain embodiments, the subject is human. In certain embodiments, the anti-PD-L1 antibody is a human sequence monoclonal antibody and the anti-GITR antibody is human sequence monoclonal antibody, such as an antibody comprising the CDRs or variable regions of 28F3, 19D3, 18E10, 3C3-1, 3C3-2, 2G6, 8A6, 9G7-1, 9G7-2, 14E3, 19H8-1, 19H8-2, and 6G10 described herein (e.g., 28F3.IgG1 or 28F3.IgG1.1) or another agonist anti-GITR antibody described herein.

In one embodiment, the anti-PD-L1 antibody is BMS-936559 (referred to as 12A4 in WO 2007/005874 and U.S. Pat. No. 7,943,743), or an antibody that comprises the CDRs or variable regions of 3G10, 12A4, 10A5, 5F8, 10H10, 1B12, 7H1, 11E6, 12B7 and 13G4, which are described in PCT Publication WO 07/005874 and U.S. Pat. No. 7,943, 743. In certain embodiment an anti-PD-L1 antibody is MEDI4736 (also known as Anti-B7-H1), MPDL3280A (also known as RG7446), MSB0010718C (WO2013/79174), or rHigM12B7. Any of the anti-PD-L1 antibodies disclosed in WO2013/173223, WO2011/066389, WO2012/145493, U.S. Pat. Nos. 7,635,757 and 8,217,149 and U.S. Publication No. 2009/145493 may also be used. Anti-PD-L1 antibodies that compete with and/or bind to the same epitope as that of any of these antibodies may also be used in combination treatments.

In certain embodiments, the anti-PD-L1 antibody binds to human PD-L1 with a $K_D$ of $5\times10^{-8}$M or less, binds to human PD-L1 with a $K_D$ of $1\times10^{-8}$M or less, binds to human PD-L1 with a $K_D$ of $5\times10^{-9}$M or less, or binds to human PD-L1 with a $K_D$ of between $1\times10^{-8}$M and $1\times10^{-10}$M or less.

Provided herein are methods for treating a hyperproliferative disease (e.g., cancer), comprising administering an anti-GITR antibody described herein and a CTLA-4 antagonist antibody to a subject. In certain embodiments, the anti-GITR antibody is administered at a subtherapeutic dose, the anti-CTLA-4 antibody is administered at a subtherapeutic dose, or both are administered at a subtherapeutic dose. Provided herein are methods for altering an adverse event associated with treatment of a hyperproliferative disease with an immunostimulatory agent, comprising administering an anti-GITR antibody and a subtherapeutic dose of anti-CTLA-4 antibody to a subject. In certain embodiments, the subject is human. In certain embodiments, the anti-CTLA-4 antibody is an antibody selected from the group of: Yervoy™ (ipilimumab or antibody 10D1, described in PCT Publication WO 01/14424), tremelimumab (formerly ticilimumab, CP-675,206), monoclonal or an anti-CTLA-4 antibody described in any of the following publications: WO 98/42752; WO 00/37504; U.S. Pat. No. 6,207,156; Hurwitz et al. (1998) *Proc. Natl. Acad. Sci. USA* 95(17):10067-10071; Camacho et al. (2004) *J. Clin. Oncology* 22(145): Abstract No. 2505 (antibody CP-675206); and Mokyr et al. (1998) *Cancer Res.* 58:5301-5304. Any of the anti-CTLA-4 antibodies disclosed in WO2013/173223 may also be used.

In certain embodiments, the anti-CTLA-4 antibody binds to human CTLA-4 with a $K_D$ of $5\times10^{-8}$M or less, binds to human CTLA-4 with a $K_D$ of $1\times10^{-8}$M or less, binds to human CTLA-4 with a $K_D$ of $5\times10^{-9}$M or less, or binds to human CTLA-4 with a $K_D$ of between $1\times10^{-8}$M and $1\times10^{-10}$M or less.

Provided herein are methods for treating a hyperproliferative disease (e.g., cancer), comprising administering an anti-GITR antibody and an anti-LAG-3 antibody to a subject. In further embodiments, the anti-GITR antibody is administered at a subtherapeutic dose, the anti-LAG-3 antibody is administered at a subtherapeutic dose, or both are administered at a subtherapeutic dose. Provide herein are methods for altering an adverse event associated with treatment of a hyperproliferative disease with an immunostimulatory agent, comprising administering an anti-GITR antibody and a subtherapeutic dose of anti-LAG-3 antibody to a subject. In certain embodiments, the subject is human. In certain embodiments, the anti-PD-L1 antibody is a human sequence monoclonal antibody and the anti-GITR antibody is human sequence monoclonal antibody, such as an antibody comprising the CDRs or variable regions of 28F3, 19D3, 18E10, 3C3-1, 3C3-2, 2G6, 8A6, 9G7-1, 9G7-2, 14E3, 19H8-1, 19H8-2, or 6G10 described herein (e.g., 28F3.IgG1 or 28F3.IgG1.1) or another agonist anti-GITR antibody described herein. Examples of anti-LAGS antibodies include antibodies comprising the CDRs or variable regions of antibodies 25F7, 26H10, 25E3, 8B7, 11F2 or 17E5, which are described in U.S. Patent Publication No. US2011/0150892, WO10/19570 and WO2014/008218. In one embodiment, an anti-LAG-3 antibody is BMS-986016. Other art recognized anti-LAG-3 antibodies that can be used include IMP731 and IMP-321, described in US 2011/007023, WO08/132601, and WO09/44273. Anti-LAG-3 antibodies that compete with and/or bind to the same epitope as that of any of these antibodies may also be used in combination treatments.

In certain embodiments, the anti-LAG-3 antibody binds to human LAG-3 with a $K_D$ of $5\times10^{-8}$M or less, binds to human LAG-3 with a $K_D$ of $1\times10^{-8}$M or less, binds to human LAG-3 with a $K_D$ of $5\times10^{-9}$M or less, or binds to human LAG-3 with a $K_D$ of between $1\times10^{-8}$M and $1\times10^{-10}$M or less.

Administration of anti-GITR antibodies described herein and antagonists, e.g., antagonist antibodies, to one or more second target antigens such as LAG-3 and/or CTLA-4 and/or PD-1 and/or PD-L1 can enhance the immune response to cancerous cells in the patient. Cancers whose growth may be inhibited using the antibodies of the instant disclosure include cancers typically responsive to immunotherapy and those that are not typically responsive to immunotherapy. Representative examples of cancers for treatment with the combination therapy of the instant disclosure include those cancers listed herein.

In certain embodiments, the combination of therapeutic antibodies discussed herein can be administered concurrently as a single composition in a pharmaceutically acceptable carrier, or concurrently as separate compositions with each antibody in a pharmaceutically acceptable carrier. In another embodiment, the combination of therapeutic antibodies can be administered sequentially. For example, an anti-CTLA-4 antibody and an anti-GITR antibody can be administered sequentially, such as anti-CTLA-4 antibody being administered first and anti-GITR antibody second, or anti-GITR antibody being administered first and anti-CTLA-4 antibody second. Additionally or alternatively, an anti-PD-1 antibody and an anti-GITR antibody can be administered sequentially, such as anti-PD-1 antibody being administered first and anti-GITR antibody second, or anti-GITR antibody being administered first and anti-PD-1 antibody second. Additionally or alternatively, an anti-PD-L1 antibody and an anti-GITR antibody can be administered sequentially, such as anti-PD-L1 antibody being administered first and anti-GITR antibody second, or anti-GITR antibody being administered first and anti-PD-L1 antibody second. Additionally or alternatively, an anti-LAG-3 antibody and an anti-GITR antibody can be administered sequentially, such as anti-LAG-3 antibody being administered first and anti-GITR antibody second, or anti-GITR antibody being administered first and anti-LAG-3 antibody second.

Furthermore, if more than one dose of the combination therapy is administered sequentially, the order of the sequential administration can be reversed or kept in the same order at each time point of administration, sequential administrations can be combined with concurrent administrations, or any combination thereof. For example, the first administration of a combination anti-CTLA-4 antibody and anti-GITR antibody can be concurrent, the second administration can be sequential with anti-CTLA-4 antibody first and anti-GITR antibody second, and the third administration can be sequential with anti-GITR antibody first and anti-CTLA-4 antibody second, etc. Additionally or alternatively, the first administration of a combination anti-PD-1 antibody and anti-GITR antibody can be concurrent, the second administration can be sequential with anti-PD-1 antibody first and anti-GITR antibody second, and the third administration can be sequential with anti-GITR antibody first and anti-PD-1 antibody second, etc. Additionally or alternatively, the first administration of a combination anti-PD-L1 antibody and anti-GITR antibody can be concurrent, the second administration can be sequential with anti-PD-L1 antibody first and anti-GITR antibody second, and the third administration can be sequential with anti-GITR antibody first and anti-PD-L1 antibody second, etc. Additionally or alternatively, the first administration of a combination anti-LAG-3 antibody and anti-GITR antibody can be concurrent, the second administration can be sequential with anti-LAG-3 antibody first and anti-GITR antibody second, and the third administration can be sequential with anti-GITR antibody first and anti-LAG-3 antibody second, etc. Another representative dosing scheme can involve a first administration that is sequential with anti-GITR first and anti-CTLA-4 antibody (and/or anti-PD-1 antibody and/or anti-PD-L1 antibody and/or anti-LAG-3 antibody) second, and subsequent administrations may be concurrent.

In one embodiment, a subject having a disease that may benefit from stimulation of the immune system, e.g., cancer or an infectious disease, is treated by administration to the subject of an anti-GITR antibody and an immuno-oncology agent, wherein the immuno-oncology agent is a CD137 (4-1BB) agonist, such as an agonistic CD137 antibody. Suitable CD137 antibodies include, for example, urelumab or PF-05082566 (WO12/32433).

In one embodiment, a subject having a disease that may benefit from stimulation of the immune system, e.g., cancer or an infectious disease, is treated by administration to the subject of an anti-GITR antibody and an immuno-oncology agent, wherein the immuno-oncology agent is an OX40 agonist, such as an agonistic OX40 antibody. Suitable OX40 antibodies include, for example, MEDI-6383, MEDI-6469 or MOXR0916 (RG7888; WO06/029879).

In one embodiment, a subject having a disease that may benefit from stimulation of the immune system, e.g., cancer or an infectious disease, is treated by administration to the subject of an anti-GITR antibody and an immuno-oncology agent, wherein the immuno-oncology agent is a CD40 agonist, such as an agonistic CD40 antibody. In certain embodiments, the immuno-oncology agent is a CD40 antagonist, such as an antagonistic CD40 antibody. Suitable CD40 antibodies include, for example, lucatumumab (HCD122), dacetuzumab (SGN-40), CP-870,893 or Chi Lob 7/4.

In one embodiment, a subject having a disease that may benefit from stimulation of the immune system, e.g., cancer or an infectious disease, is treated by administration to the subject of an anti-GITR antibody and an immuno-oncology agent, wherein the immuno-oncology agent is a CD27 agonist, such as an agonistic CD27 antibody. Suitable CD27 antibodies include, for example, varlilumab (CDX-1127).

In one embodiment, a subject having a disease that may benefit from stimulation of the immune system, e.g., cancer or an infectious disease, is treated by administration to the subject of an anti-GITR antibody and an immuno-oncology agent, wherein the immuno-oncology agent is MGA271 (to B7H3) (WO11/109400).

In one embodiment, a subject having a disease that may benefit from stimulation of the immune system, e.g., cancer or an infectious disease, is treated by administration to the subject of an anti-GITR antibody and an immuno-oncology agent, wherein the immuno-oncology agent is a KIR antagonist, such as lirilumab.

In one embodiment, a subject having a disease that may benefit from stimulation of the immune system, e.g., cancer or an infectious disease, is treated by administration to the subject of an anti-GITR antibody and an immuno-oncology agent, wherein the immuno-oncology agent is an IDO antagonist. Suitable IDO antagonists include, for example, INCB-024360 (WO2006/122150, WO07/75598, WO08/36653, WO08/36642), indoximod, NLG-919 (WO09/73620, WO09/1156652, WO11/56652, WO12/142237) or F001287.

In one embodiment, a subject having a disease that may benefit from stimulation of the immune system, e.g., cancer or an infectious disease, is treated by administration to the subject of an anti-GITR antibody and an immuno-oncology agent, wherein the immuno-oncology agent is a Toll-like receptor agonist, e.g., a TLR2/4 agonist (e.g., *Bacillus* Calmette-Guerin); a TLR7 agonist (e.g., Hiltonol or Imiquimod); a TLR7/8 agonist (e.g., Resiquimod); or a TLR9 agonist (e.g., CpG7909).

In one embodiment, a subject having a disease that may benefit from stimulation of the immune system, e.g., cancer or an infectious disease, is treated by administration to the subject of an anti-GITR antibody and an immuno-oncology agent, wherein, the immuno-oncology agent is a TGF-β inhibitor, e.g., GC1008, LY2157299, TEW7197, or IMC-TR1.

In one aspect, an anti-GITR antibody is sequentially administered prior to administration of a second agent, e.g., an immuno-oncology agent. In one aspect, an anti-GITR antibody is administered concurrently with the second agent, e.g., an immunology-oncology agent. In yet one aspect, an anti-GITR antibody is sequentially administered after administration of the second agent. The administration of the two agents may start at times that are, e.g., 30 minutes, 60 minutes, 90 minutes, 120 minutes, 3 hours, 6 hours, 12 hours, 24 hours, 36 hours, 48 hours, 3 days, 5 days, 7 days, or one or more weeks apart, or administration of the second agent may start, e.g., 30 minutes, 60 minutes, 90 minutes, 120 minutes, 3 hours, 6 hours, 12 hours, 24 hours, 36 hours, 48 hours, 3 days, 5 days, 7 days, or one or more weeks after the first agent has been administered.

In certain aspects, an anti-GITR antibody and a second agent, e.g., an immuno-oncology agent, are administered simultaneously, e.g., are infused simultaneously, e.g., over a period of 30 or 60 minutes, to a patient. An anti-GITR antibody may be co-formulated with a second agent, e.g., an immuno-oncology agent.

Optionally, an anti-GITR as sole immunotherapeutic agent, or the combination of an anti-GITR antibody and one or more additional immunotherapeutic antibodies (e.g., anti-CTLA-4 and/or anti-PD-1 and/or anti-PD-L1 and/or anti-LAG-3 blockade) can be further combined with an immunogenic agent, such as cancerous cells, purified tumor antigens (including recombinant proteins, peptides, and carbohydrate molecules), cells, and cells transfected with genes encoding immune stimulating cytokines (He et al. (2004) *J. Immunol.* 173:4919-28). Non-limiting examples of tumor vaccines that can be used include peptides of melanoma antigens, such as peptides of gp100, MAGE antigens, Trp-2, MART1 and/or tyrosinase, or tumor cells transfected to express the cytokine GM-CSF (discussed further below). A combined GITR activation and one or more additional antibodies (e.g., CTLA-4 and/or PD-1 and/or PD-L1 and/or LAG-3 blockade) can also be further combined with standard cancer treatments. For example, a combined GITR activation and one or more additional antibodies (e.g., CTLA-4 and/or PD-1 and/or PD-L1 and/or LAG-3 blockade) can be effectively combined with chemotherapeutic regimes. In these instances, it is possible to reduce the dose of other chemotherapeutic reagent administered with the combination of the instant disclosure (Mokyr et al. (1998) *Cancer Research* 58: 5301-5304). An example of such a combination is a combination of anti-GITR agonist antibody with or without and an additional antibody, such as anti-CTLA-4 antibodies and/or anti-PD-1 antibodies and/or anti-PD-L1 antibodies and/or anti-LAG-3 antibodies) further in combination with decarbazine for the treatment of melanoma. Another example is a combination of anti-GITR antibody with or without and anti-CTLA-4 antibodies and/or anti-PD-1 antibodies and/or anti-PD-L1 antibodies and/or LAG-3 antibodies further in combination with interleukin-2 (IL-2) for the treatment of melanoma. The scientific rationale behind the combined use of GITR activation and CTLA-4 and/or PD-1 and/or PD-L1 and/or LAG-3 blockade with chemotherapy is that cell death, which is a consequence of the cytotoxic action of most chemotherapeutic compounds, should result in increased levels of tumor antigen in the antigen presentation pathway. Other combination therapies that may result in synergy with a combined GITR activation with or without and CTLA-4 and/or PD-1 and/or PD-L1 and/or LAG-3 blockade through cell death include radiation, surgery, or hormone deprivation. Each of these protocols creates a source of tumor antigen in the host. Angiogenesis inhibitors can also be combined with a combined GITR activation and CTLA-4 and/or PD-1 and/or PD-L1 and/or LAG-3 blockade. Inhibition of angiogenesis leads to tumor cell death, which can be a source of tumor antigen fed into host antigen presentation pathways.

An anti-GITR agonist antibody as sole immunotherapeutic agent, or a combination of GITR agonistic and CTLA-4 and/or PD-1 and/or PD-L1 and/or LAG-3 blocking antibodies can also be used in combination with bispecific antibodies that target Fcα or Fcγ receptor-expressing effector cells to tumor cells (see, e.g., U.S. Pat. Nos. 5,922,845 and 5,837,243). Bispecific antibodies can be used to target two separate antigens. The T cell arm of these responses would be augmented by the use of a combined GITR activation and CTLA-4 and/or PD-1 and/or PD-L1 and/or LAG-3 blockade.

In another example, an anti-GITR agonist antibody as sole immunotherapeutic agent or a combination of an anti-GITR antibody and additional immunostimulating agent, e.g., anti-CTLA-4 antibody and/or anti-PD-1 antibody and/or anti-PD-L1 antibody and/or LAG-3 agent, e.g., antibody, can be used in conjunction with an anti-neoplastic antibody, such as Rituxan® (rituximab), Herceptin® (trastuzumab), Bexxar® (tositumomab), Zevalin® (ibritumomab), Campath® (alemtuzumab), Lymphocide® (eprtuzumab), Avastin® (bevacizumab), and Tarceva® (erlotinib), and the like. By way of example and not wishing to be bound by theory, treatment with an anti-cancer antibody or an anti-cancer antibody conjugated to a toxin can lead to cancer cell death (e.g., tumor cells) which would potentiate an immune response mediated by the immunostimulating agent, e.g., GITR, CTLA-4, PD-1, PD-L1 or LAG-3 agent, e.g., antibody. In an exemplary embodiment, a treatment of a hyperproliferative disease (e.g., a cancer tumor) can include an anti-cancer agent, e.g., antibody, in combination with anti-GITR and optionally an additional immunostimulating agent, e.g., anti-CTLA-4 and/or anti-PD-1 and/or anti-PD-L1 and/or anti-LAG-3 agent, e.g., antibody, concurrently or sequentially or any combination thereof, which can potentiate an anti-tumor immune responses by the host.

Tumors evade host immune surveillance by a large variety of mechanisms. Many of these mechanisms may be overcome by the inactivation of proteins, which are expressed by the tumors and which are immunosuppressive. These include, among others, TGF-β (Kehrl et al. (1986) *J. Exp. Med.* 163: 1037-1050), IL-10 (Howard & O'Garra (1992) *Immunology Today* 13: 198-200), and Fas ligand (Hahne et al. (1996) *Science* 274: 1363-1365). Antibodies to each of these entities can be further combined with an anti-GITR antibody with or without an additional immunostimulating agent, e.g., an anti-CTLA-4 and/or anti-PD-1 and/or anti-PD-L1 and/or anti-LAG-3 agent, such as antibody, to counteract the effects of immunosuppressive agents and favor anti-tumor immune responses by the host.

Other agents, e.g., antibodies, that can be used to activate host immune responsiveness can be further used in combination with an anti-GITR antibody with or without an additional immunostimulating agent, such as anti-CTLA-4 and/or anti-PD-1 and/or anti-PD-L1 and/or anti-LAG-3 antibody. These include molecules on the surface of dendritic cells that activate DC function and antigen presentation. Anti-CD40 antibodies (Ridge et al., supra) can be used in conjunction with an anti-GITR antibody and optionally an additional immunostimulating agent, e.g., an anti-CTLA-4 and/or anti-PD-1 and/or anti-PD-L1 and/or anti-LAG-3 agent, e.g., antibody. Other activating antibodies to T cell costimulatory molecules Weinberg et al., supra, Melero et al. supra, Hutloff et al., supra, may also provide for increased levels of T cell activation.

As discussed above, bone marrow transplantation is currently being used to treat a variety of tumors of hematopoietic origin. Anti-GITR immunotherapy alone or combined with CTLA-4 and/or PD-1 and/or PD-L1 and/or LAG-3 blockade can be used to increase the effectiveness of the donor engrafted tumor specific T cells.

Several experimental treatment protocols involve ex vivo activation and expansion of antigen specific T cells and adoptive transfer of these cells into recipients in order to antigen-specific T cells against tumor (Greenberg & Riddell, supra). These methods can also be used to activate T cell responses to infectious agents such as CMV. Ex vivo activation in the presence of anti-GITR with or without an additional immunostimulating therapy, e.g., anti-CTLA-4 and/or anti-PD-1 and/or anti-PD-L1 and/or anti-LAG-3 antibodies can be expected to increase the frequency and activity of the adoptively transferred T cells.

Provided herein are methods for altering an adverse event associated with treatment of a hyperproliferative disease (e.g., cancer) with an immunostimulatory agent, comprising administering an anti-GITR antibody with or without anti-CTLA-4 and/or anti-PD-1 and/or anti-PD-L1 and/or anti-LAG-3 agent, e.g., antibody, to a subject. For example, the methods described herein provide for a method of reducing the incidence of immunostimulatory therapeutic antibody-induced colitis or diarrhea by administering a non-absorbable steroid to the patient. As used herein, a "non-absorbable steroid" is a glucocorticoid that exhibits extensive first pass metabolism such that, following metabolism in the liver, the bioavailability of the steroid is low, i.e., less than about 20%. In one embodiment described herein, the non-absorbable steroid is budesonide. Budesonide is a locally-acting glucocorticosteroid, which is extensively metabolized, primarily by the liver, following oral administration. ENTOCORT EC® (Astra-Zeneca) is a pH- and time-dependent oral formulation of budesonide developed to optimize drug delivery to the ileum and throughout the colon. ENTOCORT EC® is approved in the U.S. for the treatment of mild to moderate Crohn's disease involving the ileum and/or ascending colon. The usual oral dosage of ENTOCORT EC® for the treatment of Crohn's disease is 6 to 9 mg/day. ENTOCORT EC® is released in the intestines before being absorbed and retained in the gut mucosa. Once it passes through the gut mucosa target tissue, ENTOCORT EC® is extensively metabolized by the cytochrome P450 system in the liver to metabolites with negligible glucocorticoid activity. Therefore, the bioavailability is low (about 10%). The low bioavailability of budesonide results in an improved therapeutic ratio compared to other glucocorticoids with less extensive first-pass metabolism. Budesonide results in fewer adverse effects, including less hypothalamic-pituitary suppression, than systemically-acting corticosteroids. However, chronic administration of ENTOCORT EC® can result in systemic glucocorticoid effects such as hypercorticism and adrenal suppression. See PDR 58$^{th}$ ed. 2004; 608-610.

In still further embodiments, GITR activation with or without CTLA-4 and/or PD-1 and/or PD-L1 and/or LAG-3 blockade (i.e., immunostimulatory therapeutic antibodies anti-GITR and optionally anti-CTLA-4 and/or anti-PD-1 and/or anti-PD-L1 and/or anti-LAG-3 antibodies) in conjunction with a non-absorbable steroid can be further combined with a salicylate. Salicylates include 5-ASA agents such as, for example: sulfasalazine (AZULFIDINE®, Pharmacia & UpJohn); olsalazine (DIPENTUM®, Pharmacia & UpJohn); balsalazide (COLAZAL®, Salix Pharmaceuticals, Inc.); and mesalamine (ASACOL®, Procter & Gamble Pharmaceuticals; PENTASA®, Shire US; CANASA®, Axcan Scandipharm, Inc.; ROWASA®, Solvay).

In accordance with the methods described herein, a salicylate administered in combination with anti-GITR with or without anti-CTLA-4 and/or anti-PD-1 and/or anti-PD-L1 and/or LAG-3 antibodies and a non-absorbable steroid can includes any overlapping or sequential administration of the salicylate and the non-absorbable steroid for the purpose of decreasing the incidence of colitis induced by the immunostimulatory antibodies. Thus, for example, methods for reducing the incidence of colitis induced by the immunostimulatory antibodies described herein encompass administering a salicylate and a non-absorbable concurrently or sequentially (e.g., a salicylate is administered 6 hours after a non-absorbable steroid), or any combination thereof. Further, a salicylate and a non-absorbable steroid can be administered by the same route (e.g., both are administered orally) or by different routes (e.g., a salicylate is administered orally and a non-absorbable steroid is administered rectally), which may differ from the route(s) used to administer the anti-GITR and anti-CTLA-4 and/or anti-PD-1 and/or anti-PD-L1 and/or anti-LAG-3 antibodies.

The anti-GITR antibodies and combination antibody therapies described herein may also be used in conjunction with other well known therapies that are selected for their particular usefulness against the indication being treated (e.g., cancer). Combinations of the anti-GITR antibodies described herein may be used sequentially with known pharmaceutically acceptable agent(s).

For example, the anti-GITR antibodies and combination antibody therapies described herein can be used in combination (e.g., simultaneously or separately) with an additional treatment, such as irradiation, chemotherapy (e.g., using camptothecin (CPT-11), 5-fluorouracil (5-FU), cisplatin, doxorubicin, irinotecan, paclitaxel, gemcitabine, cisplatin, paclitaxel, carboplatin-paclitaxel (Taxol), doxorubicin, 5-fu, or camptothecin+apo21/TRAIL (a 6× combo)), one or more proteasome inhibitors (e.g., bortezomib or MG132), one or more Bcl-2 inhibitors (e.g., BH3I-2' (bcl-xl inhibitor), indoleamine dioxygenase-1 inhibitor (e.g., INCB24360, indoximod, NLG-919, or F001287), AT-101 (R-(−)-gossypol derivative), ABT-263 (small molecule), GX-15-070 (obatoclax), or MCL-1 (myeloid leukemia cell differentiation protein-1) antagonists), iAP (inhibitor of apoptosis protein) antagonists (e.g., smac7, smac4, small molecule smac mimetic, synthetic smac peptides (see Fulda et al., Nat Med 2002; 8:808-15), ISIS23722 (LY2181308), or AEG-35156 (GEM-640)), HDAC (histone deacetylase) inhibitors, anti-CD20 antibodies (e.g., rituximab), angiogenesis inhibitors (e.g., bevacizumab), anti-angiogenic agents targeting VEGF and VEGFR (e.g., Avastin), synthetic triterpenoids (see Hyer et al., Cancer Research 2005; 65:4799-808), c-FLIP (cellular FLICE-inhibitory protein) modulators (e.g., natural and synthetic ligands of PPARγ (peroxisome proliferator-activated receptor γ), 5809354 or 5569100), kinase inhibitors (e.g., Sorafenib), Trastuzumab, Cetuximab, Temsirolimus, mTOR inhibitors such as rapamycin and temsirolimus, Bortezomib, JAK2 inhibitors, HSP90 inhibitors, PI3K-AKT inhibitors, Lenalildomide, GSK3β inhibitors, IAP inhibitors and/or genotoxic drugs.

The anti-GITR antibodies and combination antibody therapies described herein can further be used in combination with one or more anti-proliferative cytotoxic agents.

Classes of compounds that may be used as anti-proliferative cytotoxic agents include, but are not limited to, the following:

Alkylating agents (including, without limitation, nitrogen mustards, ethylenimine derivatives, alkyl sulfonates, nitrosoureas and triazenes): Uracil mustard, Chlormethine, Cyclophosphamide (CYTOXAN™) fosfamide, Melphalan, Chlorambucil, Pipobroman, Triethylenemelamine, Triethylenethiophosphoramine, Busulfan, Carmustine, Lomustine, Streptozocin, Dacarbazine, and Temozolomide.

Antimetabolites (including, without limitation, folic acid antagonists, pyrimidine analogs, purine analogs and adenosine deaminase inhibitors): Methotrexate, 5-Fluorouracil, Floxuridine, Cytarabine, 6-Mercaptopurine, 6-Thioguanine, Fludarabine phosphate, Pentostatine, and Gemcitabine.

Suitable anti-proliferative agents for combining with agonist anti-GITR antibodies, without limitation, taxanes, paclitaxel (paclitaxel is commercially available as TAXOL™), docetaxel, discodermolide (DDM), dictyostatin (DCT), Peloruside A, epothilones, epothilone A, epothilone B, epothilone C, epothilone D, epothilone E, epothilone F, furanoepothilone D, desoxyepothilone B1, [17]-dehydrodesoxyepothilone B, [18]dehydrodesoxyepothilones B, C12,13-cyclopropyl-epothilone A, C6-C8 bridged epothilone A, trans-9,10-dehydroepothilone D, cis-9,10-dehydroepothilone D, 16-desmethylepothilone B, epothilone B10, discoderomolide, patupilone (EPO-906), KOS-862, KOS-1584, ZK-EPO, ABJ-789, XAA296A (Discodermolide), TZT-1027 (soblidotin), ILX-651 (tasidotin hydrochloride), Halichondrin B, Eribulin mesylate (E-7389), Hemiasterlin (HTI-286), E-7974, Cyrptophycins, LY-355703, Maytansinoid immunoconjugates (DM-1), MKC-1, ABT-751, T1-38067, T-900607, SB-715992 (ispinesib), SB-743921, MK-0731, STA-5312, eleutherobin, 17beta-acetoxy-2-ethoxy-6-oxo-B-homo-estra-1,3,5(10)-trien-3-ol, cyclostreptin, isolaulimalide, laulimalide, 4-epi-7-dehydroxy-14,16-didemethyl-(+)-discodermolides, and cryptothilone 1, in addition to other microtubuline stabilizing agents known in the art.

In cases where it is desirable to render aberrantly proliferative cells quiescent in conjunction with or prior to treatment with anti-GITR antibodies described herein, hormones and steroids (including synthetic analogs), such as 17a-Ethinylestradiol, Diethylstilbestrol, Testosterone, Prednisone, Fluoxymesterone, Dromostanolone propionate, Testolactone, Megestrolacetate, Methylprednisolone, Methyltestosterone, Prednisolone, Triamcinolone, Chlorotrianisene, Hydroxyprogesterone, Aminoglutethimide, Estramustine, Medroxyprogesteroneacetate, Leuprolide, Flutamide, Toremifene, ZOLADEX™, can also be administered to the patient. When employing the methods or compositions described herein, other agents used in the modulation of tumor growth or metastasis in a clinical setting, such as antimimetics, can also be administered as desired.

Methods for the safe and effective administration of chemotherapeutic agents are known to those skilled in the art. In addition, their administration is described in the standard literature. For example, the administration of many of the chemotherapeutic agents is described in the Physicians' Desk Reference (PDR), e.g., 1996 edition (Medical Economics Company, Montvale, N.J. 07645-1742, USA); the disclosure of which is incorporated herein by reference thereto.

The chemotherapeutic agent(s) and/or radiation therapy can be administered according to therapeutic protocols well known in the art. It will be apparent to those skilled in the art that the administration of the chemotherapeutic agent(s) and/or radiation therapy can be varied depending on the disease being treated and the known effects of the chemotherapeutic agent(s) and/or radiation therapy on that disease. Also, in accordance with the knowledge of the skilled clinician, the therapeutic protocols (e.g., dosage amounts and times of administration) can be varied in view of the observed effects of the administered therapeutic agents on the patient, and in view of the observed responses of the disease to the administered therapeutic agents.

Exemplary Embodiments

1. An isolated antibody, or antigen binding portion thereof, which binds to human glucocorticoid-inducible TNF receptor (GITR) and exhibits the following properties:
(a) binds to soluble human GITR;
(b) binds to membrane bound human GITR;
(c) binds to membrane bound cynomolgus GITR;
(d) induces or enhances T cell activation;
(e) inhibits the binding of GITR ligand to GITR on 3A9-hGITR cells;
(f) at most partially inhibits the binding of GITR ligand to GITR on activated T cells;
(g) binds to a conformational epitope on mature human GITR (SEQ ID NO: 4);
(h) binds to both O-linked and N-glycosylated and unglycosylated human GITR;
(i) has agonist activity in the absence of binding to an Fc receptor, but wherein binding to an Fc receptor further enhances the agonist activity; and
(i) competes in either direction or both directions for binding to human GITR with one or more of antibodies 28F3, 3C3-1, 3C3-2, 2G6, 8A6, 9G7-1, 9G7-2, 14E3, 19H8-1, 19H8-2, 19D3, 18E10, and 6G10.

2. The antibody, or antigen binding portion thereof, of embodiment 1, wherein the antibody stimulates an anti-tumor immune response.

3. The antibody, or antigen binding portion thereof, of embodiment 1 or 2, wherein the antibody stimulates an antigen-specific T cell response.

4. The antibody, or antigen binding portion thereof, of any one of the preceding embodiments, wherein the antibody increases IL-2 and/or IFN-γ production in GITR-expressing T cells.

5. The antibody, or antigen binding portion thereof, of any one of the preceding embodiments, wherein the antibody increases T cell proliferation.

6. The antibody, or antigen binding portion thereof, of any one of the preceding embodiments, wherein the antibody does not bind to Fc receptors.

7. The antibody, or antigen binding portion thereof, of any one of embodiments 1-5, wherein the antibody binds to one or more activating FcγRs.

8. The antibody, or antigen binding portion thereof, of any one of the preceding embodiments, wherein the antibody binds to soluble human GITR with a $K_D$ of 10 nM or less as measured by Biacore.

9. The antibody, or antigen binding portion thereof, of any one of the preceding embodiments, wherein the antibody binds to membrane bound human GITR with a $K_D$ of 1 nM or less as measured by Scatchard.

10. The antibody, or antigen binding portion thereof, of any one of the preceding embodiments, wherein the antibody binds to membrane bound human GITR with an $EC_{50}$ of 1 nM or less as measured by FACS.

11. The antibody, or antigen binding portion thereof, of any one of the preceding embodiments, wherein the antibody binds to membrane bound cynomolgus GITR with an $EC_{50}$ of 10 nM or less as measured by FACS.

12. The antibody, or antigen binding portion thereof, of any one of the preceding embodiments, wherein the antibody induces or enhances T cell activation without requiring multivalent cross-linking.

13. The antibody, or antigen binding portion thereof, of any one of the preceding embodiments, wherein the antibody inhibits the binding of GITR ligand to GITR with an $EC_{50}$ of 1 µg/mL or less as measured by FACS.

14. The antibody, or antigen binding portion thereof, of any one of the preceding embodiments, wherein the antibody binds to PTGGPGCGPGRLLLGTGT (SEQ ID NO: 217) and CRDYPGEE (SEQ ID NO: 218) of mature human GITR (SEQ ID NO: 4).

15. An isolated monoclonal antibody, or antigen binding portion thereof, which specifically binds to glucocorticoid-inducible TNF receptor (GITR) and comprise the three variable heavy chain CDRs and the three variable light chain CDRs that are in the variable heavy chain and variable light chain pairs selected from the group consisting of:
    (a) SEQ ID NOs: 13 and 14;
    (b) SEQ ID NOs: 26 and 27;
    (c) SEQ ID NOs: 39 and 40;
    (d) SEQ ID NOs: 52 and 53;
    (e) SEQ ID NOs: 52 and 54;
    (f) SEQ ID NOs: 71 and 72;
    (g) SEQ ID NOs: 84 and 85;
    (h) SEQ ID NOs: 97 and 98;
    (i) SEQ ID NOs: 97 and 99;
    (j) SEQ ID NOs: 115 and 116;
    (k) SEQ ID NOs: 128 and 129;
    (l) SEQ ID NOs: 128 and 130; and
    (m) SEQ ID NOs: 335 and 336.

16. An isolated monoclonal antibody, or antigen binding portion thereof, which binds to glucocorticoid-inducible TNF receptor (GITR), comprising:
    (a) heavy chain CDR1, CDR2, and CDR3 sequences comprising SEQ ID NOs: 20, 21, and 22, respectively, and/or light chain CDR1, CDR2, and CDR3 sequences comprising SEQ ID NOs: 23, 24, and 25, respectively;
    (b) heavy chain CDR1, CDR2, and CDR3 sequences comprising SEQ ID NOs: 33, 34, and 35, respectively, and/or light chain CDR1, CDR2, and CDR3 sequences comprising SEQ ID NOs: 36, 37, and 38, respectively;
    (c) heavy chain CDR1, CDR2, and CDR3 sequences comprising SEQ ID NOs: 46, 47, and 48, respectively, and/or light chain CDR1, CDR2, and CDR3 sequences comprising SEQ ID NOs: 49, 50, and 51, respectively;
    (d) heavy chain CDR1, CDR2, and CDR3 sequences comprising SEQ ID NOs: 62, 63, and 64, respectively, and/or light chain CDR1, CDR2, and CDR3 sequences comprising SEQ ID NOs: 65, 66, and 67, respectively;
    (e) heavy chain CDR1, CDR2, and CDR3 sequences comprising SEQ ID NOs: 62, 63, and 64, respectively, and/or light chain CDR1, CDR2, and CDR3 sequences comprising SEQ ID NOs: 68, 69, and 70, respectively;
    (f) heavy chain CDR1, CDR2, and CDR3 sequences comprising SEQ ID NOs: 78, 79, and 80, respectively, and/or light chain CDR1, CDR2, and CDR3 sequences comprising SEQ ID NOs: 81, 82, and 83, respectively;
    (g) heavy chain CDR1, CDR2, and CDR3 sequences comprising SEQ ID NOs: 91, 92, and 93, respectively, and/or light chain CDR1, CDR2, and CDR3 sequences comprising SEQ ID NOs: 94, 95, and 96, respectively;
    (h) heavy chain CDR1, CDR2, and CDR3 sequences comprising SEQ ID NOs: 106, 107, and 108, respectively, and/or light chain CDR1, CDR2, and CDR3 sequences comprising SEQ ID NOs: 109, 110, and 111, respectively;
    (i) heavy chain CDR1, CDR2, and CDR3 sequences comprising SEQ ID NOs: 106, 107, and 108, respectively, and/or light chain CDR1, CDR2, and CDR3 sequences comprising SEQ ID NOs: 112, 113, and 114, respectively;
    (j) heavy chain CDR1, CDR2, and CDR3 sequences comprising SEQ ID NOs: 122, 123, and 124, respectively, and/or light chain CDR1, CDR2, and CDR3 sequences comprising SEQ ID NOs: 125, 126, and 127, respectively;
    (k) heavy chain CDR1, CDR2, and CDR3 sequences comprising SEQ ID NOs: 138, 139, and 140, respectively, and/or light chain CDR1, CDR2, and CDR3 sequences comprising SEQ ID NOs: 141, 142, and 143, respectively;
    (l) heavy chain CDR1, CDR2, and CDR3 sequences comprising SEQ ID NOs: 138, 139, and 140, respectively, and/or light chain CDR1, CDR2, and CDR3 sequences comprising SEQ ID NOs: 144, 145, and 146, respectively; or
    (m) heavy chain CDR1, CDR2, and CDR3 sequences comprising SEQ ID NOs: 342, 343, and 344, respectively, and/or light chain CDR1, CDR2, and CDR3 sequences comprising SEQ ID NOs: 345, 346, and 347, respectively.

17. The antibody, or antigen binding portion thereof, of embodiment 16, wherein the antibody comprises heavy chain CDR1, CDR2, and CDR3 sequences comprising SEQ ID NOs: 20, 21, and 22, respectively, and/or light chain CDR1, CDR2, and CDR3 sequences comprising SEQ ID NOs: 23, 24, and 25, respectively.

18. The antibody, or antigen binding portion thereof, of embodiment 16, wherein the antibody comprises heavy chain CDR1, CDR2, and CDR3 sequences comprising SEQ ID NOs: 33, 34, and 35, respectively, and/or light chain CDR1, CDR2, and CDR3 sequences comprising SEQ ID NOs: 36, 37, and 38, respectively.

19. The antibody, or antigen binding portion thereof, of embodiment 16, wherein the antibody comprises heavy chain CDR1, CDR2, and CDR3 sequences comprising SEQ ID NOs: 46, 47, and 48, respectively, and/or light chain CDR1, CDR2, and CDR3 sequences comprising SEQ ID NOs: 49, 50, and 51, respectively.

20. An isolated monoclonal antibody, or antigen binding portion thereof, which binds to glucocorticoid-inducible TNF receptor (GITR) and comprises heavy and light chain variable regions, wherein the heavy chain variable region comprises an amino acid sequence which is at least 90% identical to the amino acid sequence selected from the group consisting of SEQ ID NOs: 13, 26, 39, 52, 71, 84, 97, 115, 128, and 335.

21. An isolated monoclonal antibody, or antigen binding portion thereof, which binds to glucocorticoid-inducible TNF receptor (GITR) and comprises heavy and light chain variable regions, wherein the light chain variable region comprises an amino acid sequence which is at least 90% identical to the amino acid sequence selected from the group consisting of SEQ ID NOs: 14, 27, 40, 53, 54, 72, 85, 98, 99, 116, 129, 130, and 336.

22. An isolated monoclonal antibody, or antigen binding portion thereof, which binds to glucocorticoid-inducible TNF receptor (GITR) and comprises heavy and light chain variable region sequences at least 85% identical to the amino acid sequences selected from the group consisting of:
    (a) SEQ ID NOs: 13 and 14, respectively;
    (b) SEQ ID NOs: 26 and 27, respectively;
    (c) SEQ ID NOs: 39 and 40, respectively;

(d) SEQ ID NOs: 52 and 53, respectively;
(e) SEQ ID NOs: 52 and 54, respectively;
(f) SEQ ID NOs: 71 and 72, respectively;
(g) SEQ ID NOs: 84 and 85, respectively;
(h) SEQ ID NOs: 97 and 98, respectively;
(i) SEQ ID NOs: 97 and 99, respectively;
(j) SEQ ID NOs: 115 and 116, respectively;
(k) SEQ ID NOs: 128 and 129, respectively;
(l) SEQ ID NOs: 128 and 130, respectively; and
(m) SEQ ID NOs: 335 and 336, respectively.

23. The antibody, or antigen binding portion thereof, of embodiment 22, wherein the heavy and light chain variable regions comprise an amino acid sequence at least 90% identical to the heavy and light chain variable regions selected from the group consisting of (a)-(m).

24. The antibody, or antigen binding portion thereof, of embodiment 23, wherein the heavy and light chain variable region comprises an amino acid sequence at least 95% identical to the heavy and light chain variable regions selected from the group consisting of (a)-(m).

25. The antibody, or antigen binding portion thereof, of embodiment 24, wherein the heavy and light chain variable region comprises the heavy and light chain variable regions selected from the group consisting of (a)-(m).

26. The antibody, or antigen binding portion thereof, of embodiment 25, wherein the antibody comprises a heavy chain variable region comprising the amino acid sequence set forth in SEQ ID NO: 13 and a light chain variable region comprising the amino acid sequence set forth in SEQ ID NO: 14.

27. The antibody, or antigen binding portion thereof, of embodiment 25, wherein the antibody comprises a heavy chain variable region comprising the amino acid sequence set forth in SEQ ID NO: 26 and a light chain variable region comprising the amino acid sequence set forth in SEQ ID NO: 27.

28. The antibody, or antigen binding portion thereof, of embodiment 25, wherein the antibody comprises a heavy chain variable region comprising the amino acid sequence set forth in SEQ ID NO: 39 and/or a light chain variable region comprising the amino acid sequence set forth in SEQ ID NO: 40.

29. An isolated monoclonal antibody, or antigen binding portion thereof, which binds to glucocorticoid-inducible TNF receptor (GITR) and comprises heavy chain and light chain sequences at least 80%, 85%, 90%, 95%, 96%, 97%, 98% or 99% identical to the amino acid sequences selected from the group consisting of:
(a) SEQ ID NOs: 15 and 16, respectively;
(b) SEQ ID NOs: 17 and 19, respectively;
(c) SEQ ID NOs: 18 and 19, respectively;
(d) SEQ ID NOs: 28 and 29, respectively;
(e) SEQ ID NOs: 30 and 32, respectively;
(f) SEQ ID NOs: 31 and 32, respectively;
(g) SEQ ID NOs: 41 and 42, respectively;
(h) SEQ ID NOs: 43 and 45, respectively;
(i) SEQ ID NOs: 44 and 45, respectively;
(j) SEQ ID NOs: 55 and 56, respectively;
(k) SEQ ID NOs: 55 and 57, respectively;
(l) SEQ ID NOs: 58 and 60, respectively;
(m) SEQ ID NOs: 59 and 60, respectively;
(n) SEQ ID NOs: 58 and 61, respectively;
(o) SEQ ID NOs: 59 and 61, respectively;
(p) SEQ ID NOs: 73 and 74, respectively;
(q) SEQ ID NOs: 75 and 77, respectively;
(r) SEQ ID NOs: 76 and 77, respectively;
(s) SEQ ID NOs: 86 and 87, respectively;
(t) SEQ ID NOs: 88 and 90, respectively;
(u) SEQ ID NOs: 89 and 90, respectively;
(v) SEQ ID NOs: 102 and 104, respectively;
(w) SEQ ID NOs: 103 and 104, respectively;
(x) SEQ ID NOs: 100 and 101, respectively;
(y) SEQ ID NOs: 100 and 371, respectively;
(z) SEQ ID NOs: 102 and 105, respectively;
(za) SEQ ID NOs: 103 and 105, respectively;
(zb) SEQ ID NOs: 117 and 118, respectively;
(zc) SEQ ID NOs: 119 and 121, respectively;
(zd) SEQ ID NOs: 120 and 121, respectively;
(ze) SEQ ID NOs: 131 and 132, respectively;
(zf) SEQ ID NOs: 134 and 136, respectively;
(zg) SEQ ID NOs: 135 and 136, respectively;
(zh) SEQ ID NOs: 131 and 133, respectively;
(zi) SEQ ID NOs: 134 and 137, respectively;
(zj) SEQ ID NOs: 135 and 137, respectively;
(zk) SEQ ID NOs: 337 and 338, respectively;
(zl) SEQ ID NOs: 339 and 341, respectively; and
(zm) SEQ ID NOs: 340 and 341, respectively.

30. The antibody, or antigen binding portion thereof, of embodiment 29, wherein the heavy and light chains comprises the heavy and light chains selected from the group consisting of (a)-(zm).

31. The antibody, or antigen binding portion thereof, of embodiment 30, wherein the antibody comprises a heavy chain comprising the amino acid sequence set forth in SEQ ID NO: 17 and a light chain comprising the amino acid sequence set forth in SEQ ID NO: 19.

32. The antibody, or antigen binding portion thereof, of embodiment 30, wherein the antibody comprises a heavy chain comprising the amino acid sequence set forth in SEQ ID NO: 18 and a light chain comprising the amino acid sequence set forth in SEQ ID NO: 19.

33. An isolated monoclonal antibody, or antigen binding portion thereof, which (a) binds to the same epitope on GITR as the antibody of embodiment 25, and (b) inhibits binding of the antibody of embodiment 25 to GITR on activated T cells by at least 90% as measured by FACS.

34. The antibody, or antigen binding portion thereof, of any one of embodiments 15-33, wherein the antibody binds to PTGGPGCGPGRLLLGTGT (SEQ ID NO: 217) and CRDYPGEE (SEQ ID NO: 218) of mature human GITR (SEQ ID NO: 4).

35. The antibody, or antigen binding portion thereof, of any one of embodiments 15-34, wherein the antibody binds to both human and cynomolgus GITR.

36. The antibody, or antigen binding portion thereof, of any one of the preceding embodiments, wherein the antibody is selected from the group consisting of an IgG1, an IgG2, an IgG3, an IgG4 or a variant thereof.

37. The antibody, or antigen binding portion thereof, of embodiment 36, wherein the antibody is an IgG1 antibody.

38. The antibody, or antigen binding portion thereof, of embodiment 36, wherein the antibody comprises an effectorless IgG1 Fc.

39. The antibody, or antigen binding portion thereof, of embodiment 38, wherein the antibody, or antigen binding portion thereof, comprises an effectorless IgG1 Fc that comprises the following mutations: L234A, L235E, G237A, A330S and P331S.

40. The antibody of embodiment 36, wherein the antibody, or antigen binding portion thereof, comprises an Fc having enhanced binding to an activating FcγR.

41. The antibody, or antigen binding portion thereof, of any one of the preceding embodiments, wherein methionine residues in the CDR regions are substituted for amino acid residues that do not undergo oxidation.

42. The antibody, or antigen binding portion thereof, of any one of embodiments 15-41, wherein the antibody, or antigen binding portion thereof, is a human or humanized antibody.

43. A bispecific molecule comprising the antibody of any one of the preceding embodiments linked to a molecule having a second binding specificity.

44. A nucleic acid encoding the heavy and/or light chain variable region of the antibody, or antigen binding portion thereof, of any one of embodiments 1-42.

45. An expression vector comprising the nucleic acid molecule of embodiment 44.

46. A cell transformed with an expression vector of embodiment 45.

47. An immunoconjugate comprising the antibody according to any one of embodiments 1-42, linked to an agent.

48. A composition comprising the antibody, or antigen binding portion thereof, bispecific molecule or immunoconjugate, of any one of embodiments 1-43 and 47, and a carrier.

49. A kit comprising the antibody, or antigen binding portion thereof, or bispecific molecule, or immunoconjugate of any one of embodiments 1-43 and 47 and instructions for use.

50. A method of preparing an anti-GITR antibody, or antigen binding portion thereof, comprising expressing the antibody, or antigen binding portion thereof, in the cell of embodiment 46 and isolating the antibody, or antigen binding portion thereof, from the cell.

51. A method of stimulating an antigen-specific T cell response comprising contacting the T cell with the antibody, or antigen binding portion thereof, bispecific molecule or immunoconjugate, of any one of embodiments 1-43 and 47 such that an antigen-specific T cell response is stimulated.

52. A method of activating or co-stimulating an effector T cell, comprising contacting an effector T cell with an anti-GITR antibody, or antigen binding portion thereof, bispecific molecule or immunoconjugate, of any one of embodiments 1-43 and 47 and CD3, wherein the effector T cell is activated or co-stimulated.

53. A method of increasing IL-2 and/or IFN-γ production in a T cell comprising contacting the T cell with an effective amount of the antibody, or antigen binding portion thereof, bispecific molecule or immunoconjugate, of any one of embodiments 1-43 and 47.

54. A method of increasing T cell proliferation comprising contacting the cell with an effective amount of the antibody, or antigen binding portion thereof, bispecific molecule or immunoconjugate, of any one of embodiments 1-43 and 47.

55. A method of increasing IL-2 and/or IFN-γ production in T cells in a subject comprising administering an effective amount of the antibody, or antigen binding portion thereof, bispecific molecule or immunoconjugate, of any one of embodiments 1-43 and 47, to increase IL-2 and/or IFN-γ production from the T cells.

56. A method of reducing or depleting the number of T regulatory cells in a tumor of a subject in need thereof comprising administering an effective amount of an antibody, or antigen binding portion thereof, bispecific molecule or immunoconjugate, of any one of embodiments 1-43 and 47, wherein the antibody, or antigen binding portion thereof, has effector or enhanced effector function, to reduce the number of T regulatory cells in the tumor.

57. A method of stimulating an immune response in a subject comprising administering the antibody, or antigen binding portion thereof, bispecific molecule or immunoconjugate, of any one of embodiments 1-43 and 47 to the subject such that an immune response in the subject is stimulated.

58. The method of embodiment 57, wherein the subject has a tumor and an immune response against the tumor is stimulated.

59. A method for inhibiting the growth of tumor cells in a subject comprising administering to the subject the antibody, or antigen binding portion thereof, bispecific molecule or immunoconjugate, of any one of embodiments 1-43 and 47, such that growth of the tumor is inhibited in the subject.

60. A method of treating cancer comprising administering to a subject in need thereof a therapeutically effective amount of the antibody, or antigen binding portion thereof, bispecific molecule or immunoconjugate, of any one of embodiments 1-43 and 47, to treat the cancer.

61. The method of embodiment 60, wherein the cancer is selected from the group consisting of: bladder cancer, breast cancer, uterine/cervical cancer, ovarian cancer, prostate cancer, testicular cancer, esophageal cancer, gastrointestinal cancer, pancreatic cancer, colorectal cancer, colon cancer, kidney cancer, head and neck cancer, lung cancer, stomach cancer, germ cell cancer, bone cancer, liver cancer, thyroid cancer, skin cancer, neoplasm of the central nervous system, lymphoma, leukemia, myeloma, sarcoma, and virus-related cancer.

62. The method of embodiment 60 or 61, wherein the cancer is a metastatic cancer, refractory cancer, or recurrent cancer.

63. The method of any one of embodiments 56-62, further comprising administering one or more additional therapeutics.

64. The method of embodiment 63, wherein the additional therapy is an anti-PD1 antibody, a LAG-3 antibody, a CTLA-4 antibody, or a PD-L1 antibody.

65. A method of detecting the presence of glucocorticoid-inducible TNF receptor (GITR) in a sample comprising contacting the sample with the antibody, or antigen binding portion thereof, of any one of embodiments 1-42, under conditions that allow for formation of a complex between the antibody, or antigen binding portion thereof, and GITR, and detecting the formation of a complex.

66. An isolated anti-GITR antibody comprising a modified heavy chain constant region that comprises an IgG2 hinge and at least one of CH1, CH2 and CH3 that is not of an IgG2 isotype, wherein the anti-GITR antibody has enhanced agonist activity relative to the same anti-GITR antibody but with a non-IgG2 hinge.

67. The isolated anti-GITR antibody of embodiment 66, wherein the modified heavy chain constant region comprises a heavy chain constant region comprising an amino acid sequence selected from the group consisting of SEQ ID NOs: 223-226 and 283-290 or a heavy chain constant region that differs therefrom in at most 5 amino acids or is at least 95%, 96%, 97%, 98% or 99% identical to an amino acid sequence of SEQ ID NOs: 223-226 and 283-290.

68. The isolated anti-GITR antibody of embodiment 67, wherein the heavy chain comprises an amino acid sequence selected from the group consisting of SEQ ID NOs: 15, 17, 18, 28, 30, 31, 41, 43, 44, 55, 58, 59, 73, 75, 76, 86, 88, 89, 100, 102, 103, 117, 119, 120, 131, 134, 135, 227-275, 337, 339, 340, 348-352, 361, and 362, or a heavy chain chain that differs therefrom in at most 10 amino acids or is at least 95%, 96%, 97%, 98% or 99% identical to an amino acid sequence of SEQ ID NOs: 15, 17, 18, 28, 30, 31, 41, 43, 44, 55, 58, 59, 73, 75, 76, 86, 88, 89, 100, 102, 103, 117, 119, 120, 131, 134, 135, 227-275, 337, 339, 340, 348-352, 361, and 362.

The present disclosure is further illustrated by the following examples, which should not be construed as further limiting. The contents of all figures and all references, Genbank sequences, patents and published patent applications cited throughout this application are expressly incorporated herein by reference. In particular, the disclosures of PCT publications WO 09/045957, WO 09/073533, WO 09/073546, WO 09/054863 and PCT/US2013/072918, and U.S. Patent Publication No. 2011/0150892 are expressly incorporated herein by reference.

EXAMPLES

Example 1: Generation of Different Anti-GITR Antibodies

Human anti-GITR monoclonal antibodies were generated in Hco7, Hco27, Hco20, Hco12, Hco17, and Hc2 strains of HuMAb® transgenic mice ("HuMAb" is a Trade Mark of Medarex, Inc., Princeton, N.J.) and KM mice (the KM Mouse® strain contains the SC20 transchromosome as described in PCT Publication WO 02/43478). HC2/KCo27 HuMAb mice and KM mice were generated as described in U.S. Pat. Nos. 5,770,429 and 5,545,806, the entire disclosures of which are hereby incorporated by reference.

A total of 94 mice, including 7 genotypes of transgenic mice (KM, Hco7, Hco27, Hco20, Hco12, Hco17 and Hc2), were immunized with different immunization strategies (different antigen, different dose, duration, routes of administration (footpad (fp), intraperitoneal (ip) and subcutaneous (sc) and adjuvant (CFA/IFA, Ribi and antibody), etc). 36 fusions from 54 mice were performed and screened. 157 antibodies were identified from these 36 fusions, and further characterization led to the isolation of antibodies of particular interest, including the antibodies designated as 28F3, 19D3, 18E10, 3C3, 2G6, 8A6, 9G7, 14E3, 19H8, and 6G10.

cDNA sequencing identified one heavy and one light chain for each of antibodies 28F3, 19D3, 18D10, 2G6, 8A6, 14E3 and 6G10, and one heavy chain and two light chains (light chain 1 or "L1" and light chain 2 or "L2") for each of antibodies 3C3, 9G7 and 19H8. By protein analysis, a single light chain was identified for antibodies 3C3 and 9G7, and N-terminal sequencing and molecular weight determination indicated that it was light chain L1 for 3C3 and light chain L2 for 9G7. With regard to antibody 19H8, 93% of the antibodies expressed by the hybridoma contained light chain L1 and 3% contained light chain L2. Antibodies 3C3-1 and 3C3-2 correspond to antibody 3C3 with a light chain L1 and L2, respectively. Antibodies 9G7-1 and 9G7-2 correspond to antibody 9G73 with a light chain L1 and L2, respectively. Antibodies 19H8-1 and 19H8-2 correspond to antibody 19H8 with a light chain L1 and L2, respectively. The amino acid and nucleotide sequences of each of the light chains of the 3 antibodies are provided in Table 15.

The variable region amino acid sequences and the isotype of antibodies 28F3, 19D3, 18E10, 3C3 (3C3-1 and 3C3-2), 2G6, 8A6, 9G7 (9G7-1 and 9G7-2), 14E3, 19H8 (19H8-1 and 19H8-2) and 6G10 are set forth in FIGS. 2-31. The amino acid and nucleotide sequences of the light and heavy chains of each antibody are provided in Table 15. The heavy and light chains of 28F3 consist of amino acid sequences SEQ ID NOs: 15 and 16. The heavy and light chains of 19D3 consist of amino acid sequences SEQ ID NOs: 28 and 29. The heavy and light chains of 18E10 consist of amino acid sequences SEQ ID NOs: 41 and 42. The heavy and light chains of 3C3 consist of amino acid sequences SEQ ID NOs: 55 and 56. The heavy and light chains of 2G6 consist of amino acid sequences SEQ ID NOs: 73 and 74. The heavy and light chains of 8A6 consist of amino acid sequences SEQ ID NOs: 86 and 87. The heavy and light chains of 9G7 consist of amino acid sequences SEQ ID NOs: 100 and 101. The heavy and light chains of 14E3 consist of amino acid sequences SEQ ID NOs: 117 and 118. The heavy and light chains of 19H8-1 consist of amino acid sequences SEQ ID NOs: 131 and 132. The heavy and light chains of 19H8-2 consist of amino acid sequences SEQ ID NOs: 131 and 133. The heavy and light chains of 6G10 consist of amino acid sequences 337 and 338. The nucleotide sequences encoding these proteins are provided in Table 15.

Example 2: Binding of Anti-GITR Antibodies to Activated Human and Cyno T Cells

The human monoclonal anti-GITR antibodies generated in Example 1 were tested for binding to activated human and cyno T cells, which express GITR on their surface.

Peripheral Blood Mononuclear Cells (PBMCs) isolated from human or cynomolgus monkey were activated with plate-coated anti-CD3 antibody (Clone: UCHT1 for human T cell activation; Clone: SP34 for cynomolgus T cell activation; both from BD Biosciences) and soluble anti-CD28 antibody (Clone: CD28.2 for both human and cynomolgus monkey, BD Biosciences) for 4 days (human)/or 5 days (cynomolgus monkey). The cells were tested for GITR mAb binding in a fluorescence-activated cell sorting (FACS)-based assay using a phycoerythrin (PE)-conjugated anti-human IgG antibody (Jackson ImmunoResearch). The samples were analyzed on a BD FACS Canto Flow Cytometer.

Figure 33:
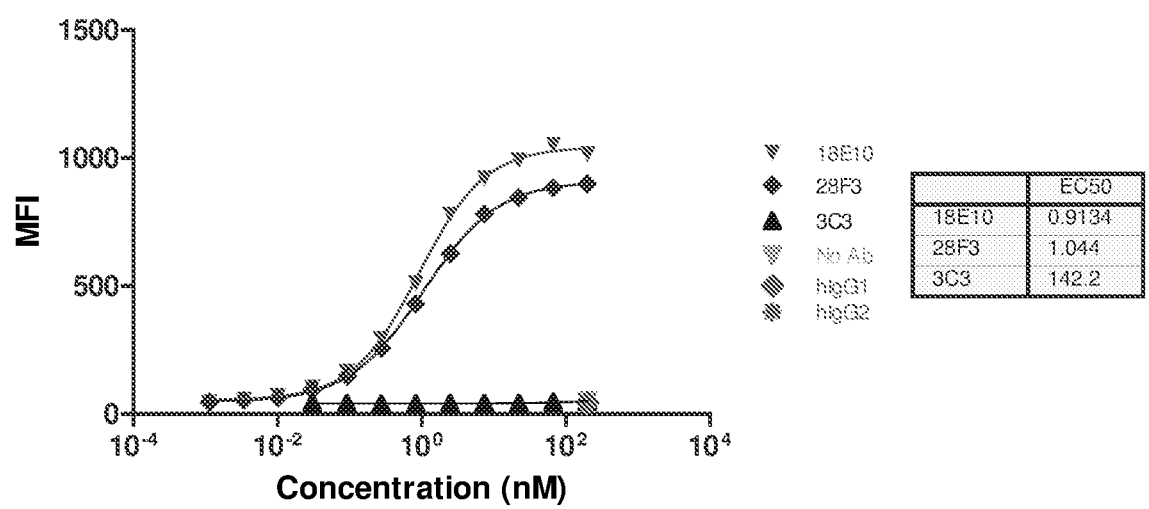
FIG. 33 shows the binding affinity (in nM) of various anti-GITR antibodies for activated cynomolgus T cells, with no antibody and hIgG1 and hIgG2 antibodies as controls, as assessed by FACS.

Anti-GITR antibodies 3C3, 19D3, 18E10, and 28F3, bound to both activated human and cynomolgus T cells. As shown in FIG. 32, antibodies 3C3, 19D3, 18E10, and 28F3 bound strongly to activated human T cells, as reflected in EC50 values of 0.04916 nM, 0.3633 nM, 0.1461 nM and 0.1916 nM, respectively. Similarly, antibodies 18E10 and 28F3 bound to activated cynomolgus T cells, with EC50 values for 18E10 and 28F3 of 0.9134 nM and 1.044 nM, respectively (FIG. 33). 3C3 did not bind significantly to cynomolgus T cells.

Example 3: Binding of Anti-GITR Antibodies to Soluble GITR

Binding of anti-GITR antibodies to soluble GITR was determined by Biacore. Anti-GITR antibodies were captured on human kappa coated chips (~5KRUs; Southernbiotech cat #2060-01), and recombinant human GITR (rHGITR/Fc: R&D systems, CAT #689-GR) was flowed across the chip at concentrations of 500 nM, 250 nM, 125 nM, 62 nM, and 31 nM. The capture concentration of the mAb/volume was 2-40 µg/mL (5 µL at 10 µL/min). The antigen association time was 5 minutes at 15 µL/min, the antigen dissociation time was 6 minutes, and regeneration was performed with 50 mM HCl/50 mM NaOH (12 µL each at 100 µL/min). The results obtained with 28F3 and several other anti-GITR antibodies are shown in Table 5.

TABLE 5

Kon (ka), Koff (kd) and $K_D$ of antiGITR antibodies

| GITR-mabs | GITR Human antigen (Anti-Kappa capture of antibody) | | |
|---|---|---|---|
| | ka (1/Ms) | kd (1/s) | KD (M) |
| 2G6 | 1.23E+05 | 1.47E−03 | 1.20E−08 |
| 3C3 sublone 1 | 4.14E+05 | 5.52E−03 | 1.33E−08 |
| 18E10 | 1.82E+05 | 2.41E−03 | 1.33E−08 |
| 3C3 sublcone 2 | 4.30E+05 | 6.20E−03 | 1.44E−08 |
| 28F3 | 3.97E+05 | 5.89E−03 | 1.48E−08 |
| 19D3 | 2.76E+05 | 4.50E−03 | 1.63E−08 |
| 9G7 | 2.14E+05 | 7.48E−03 | 3.50E−08 |
| 6G10 | 3.83E+05 | 7.15E−04 | 1.87E−09 |

The results indicate that the anti-GITR antibodies bind to soluble GITR with a $K_D$ ranging from 1.2 $10^{-8}$ to 3.5 $10^{-8}$M. Data is provided for 2 subclones of 3C3, with a $K_D$ ranging from 1.33 $10^{-8}$ to 1.44 $10^{-8}$M.

In a separate Biacore experiment, the binding characteristics of antibodies having the variable regions of 28F3 with three different constant regions were determined. The first 28F3 antibody has a wildtype IgG1 constant region ("g1f", also referred to as "g1" or "IgG1" or "IgG1f"; heavy chain having SEQ ID NO: 17 and light chain having SEQ ID NO: 19). The suffix "f" refers to the allotype. The second antibody has an effectorless IgG1 constant region having three mutations in the Fc region ("g1.1f", also referred to as "g1.1", "IgG1.1" and "IgG1.1f" having L234A, L235E, G237A; heavy chain having SEQ ID NO: 18 and light chain having SEQ ID NO: 19); and the third 28F3 antibody has an IgG1 constant region having an N297A mutation.

The Biacore experiment was conducted as described above, except that the chips were coated with anti-CH1 (Invitrogen Ref #054500). The results, which are shown in Table 6, indicate that all three antibodies have similar binding characteristics, with a $K_D$ ranging from $3.93 \times 10^{-8}$M to $4.39 \times 10^{-8}$ M.

TABLE 6

Kinetic characteristics of 28F3 having various Fcs

| Sample | ka (1/Ms) | kd (1/s) | KD (M) | Functional Concentration |
|---|---|---|---|---|
| 28F3-g1f | 8.85E+4 | 3.88E−3 | 4.39E−8 | 100% |
| 28F3-IgG1.1 | 9.09E+4 | 3.58E−3 | 3.93E−8 | 100% |
| 28F3-N297A | 7.88E+4 | 3.36E−3 | 4.26E−8 | 100% |

Example 4: Binding Affinity of Anti-GITR Antibodies to Activated Human T Cells and 3A9-huGITR Cells Binding of anti-GITR antibodies to GITR on activated human T cells and mouse T cell hybridoma 3A9 cell line which ectopically expresses human GITR (3A9-hGITR) was determined by Scatchard analysis. This assay was conducted with 28F3.IgG1.1 (SEQ ID NO: 18 for heavy chain and SEQ ID NO: 19 for light chain) at 4.59 mg/mL.

Scatchard analysis on activated human T cells was conducted as follows. T cells obtained from a human donor were washed once with culture medium (RPMI with 10% FBS, 2 mM L-Glutamine, Sodium Pyruvate, 2-mercaptoethanol) and resuspended in the same culture medium supplemented with 1 µg/mL anti-CD28 (CD28.2, BD #555725) and 100U/mL IL-2 (Peprotech #200-02) at $10^6$ cells/mL. $5 \times 10^6$ cells each were plated in three wells of a 6-well plate which was coated with 20 ug anti-CD3 (5 mL, 4 µg/mL, overnight at 4° C.; UCHT-1, BD #555329). The cells were incubated for 3 days at 37° C., and half of these cells were used for Scatchard analysis ("day 3" analysis). The spent medium of the other half was replaced with 5 mL of fresh medium and the cells were incubated for another day, and then used for Scatchard analysis ("day 4" analysis) with these cells.

For the Scatchard analysis, 28F3.IgG1.1 was radio iodinated with $^{125}$I—Na (Perkin Elmer # NEZ033H001MC (1mCi) using IODO-GEN® solid phase iodination reagent (1,3,4,6-tetrachloro-3a-6a-diphenylglycouril; Pierce #28601). Excess iodide was removed using a desalting column (Pierce #43243). Fractions of labeled antibody were collected and analyzed for radioactivity on a Wizard 1470 gamma counter (Perkin-Elmer). The $^{125}$I-28F3.IgG1.1 concentration in each fraction was calculated with the Qubit™ fluorometer from Invitrogen. Radiopurity was established by thin layer chromatography of peak protein and radioactive fractions (Pinestar Technology #151-005).

Radio iodinated 28F3.IgG1.1 binding to activated human T cells was demonstrated by incubating the activated human T cells with a titration of $^{125}$I-28F3.IgG1.1. Nonspecific binding was determined by binding in the presence of a titration of a 100 fold molar excess of unlabeled antibody and was subtracted from total CPM to calculate specific binding. A linear standard curve of $^{125}$I-28F3.IgG1.1 concentration versus CPM was used to extrapolate maximal nM bound $^{125}$I-28F3.IgG1.1 and thereby calculate receptor number per cell. The number of human GITR molecules per stimulated human CD4+ T cell on day 3 was about 8,400, and on day 4, about 13,200. The results of the Scatchard analysis indicate that 28F3.IgG1.1 specifically binds to 3 day stimulated human CD4+ T cells with a $K_D$ of 0.7 nM and to 4 day stimulated human CD4+ T cells with a $K_D$ of 0.87 nM.

Radio iodinated 28F3.IgG1.1 binding to 3A9-huGITR cells was demonstrated by incubating 3A9-huGITR cells with a titration of $^{125}$I-28F3.IgG1.1. Nonspecific binding was determined by binding in the presence of a titration of a 100 fold molar excess of unlabeled antibody and was subtracted from total CPM to calculate specific binding. A linear standard curve of $^{125}$I-28F3.IgG1.1 concentration versus CPM was used to extrapolate maximal nM bound $^{125}$I-28F3. IgG1.1 and thereby calculate receptor number per cell. The number of human GITR molecules per 3A9-huGITR cell was about 180,000. The results of the Scatchard analysis indicate that 28F3.IgG1.1 specifically binds to 3A9-huGITR cells with a $K_D$ of 0.5 nM.

In another experiment, the binding of 28F3.IgG1 and 28F3.IgG1.1 to activated CD4+ and CD8+ T cells from human and cyno donors was determined. Human and cyno CD4+ and CD8+ T cells were isolated from human and cyno donors, and treated with anti-CD3 and anti-CD28 antibodies for activation. The results indicate that 28F3.IgG1 and 28.IgG1.1 bind similarly to activated human CD4+ cells, with EC50s of 0.55 nM and 0.67 nM, respectively, and similarly to activated human CD8+ cells, with EC50s of 0.56 nM and 0.65 nM, respectively. 28F3.IgG1 and 28.IgG1.1 bind to activated cyno CD4+ cells, with EC50s of 1 nM and 0.86 nM, respectively, and similarly to activated cyno CD8+ cells, with EC50s of 1.26 nM and 0.74 nM, respectively.

Figure 34A:
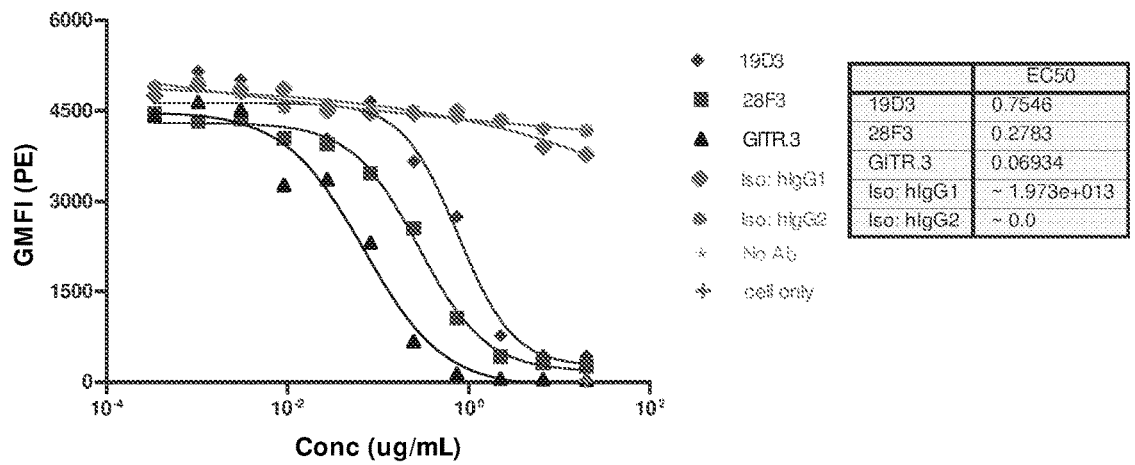
FIGS. 34A and 34B show the ability of various anti-GITR antibodies to inhibit the binding of GITR ligand (GITR-L) to GITR 3A9 cells, with hIgG1, hIgG2, no antibody, and cells alone as controls.
Figure 34B:
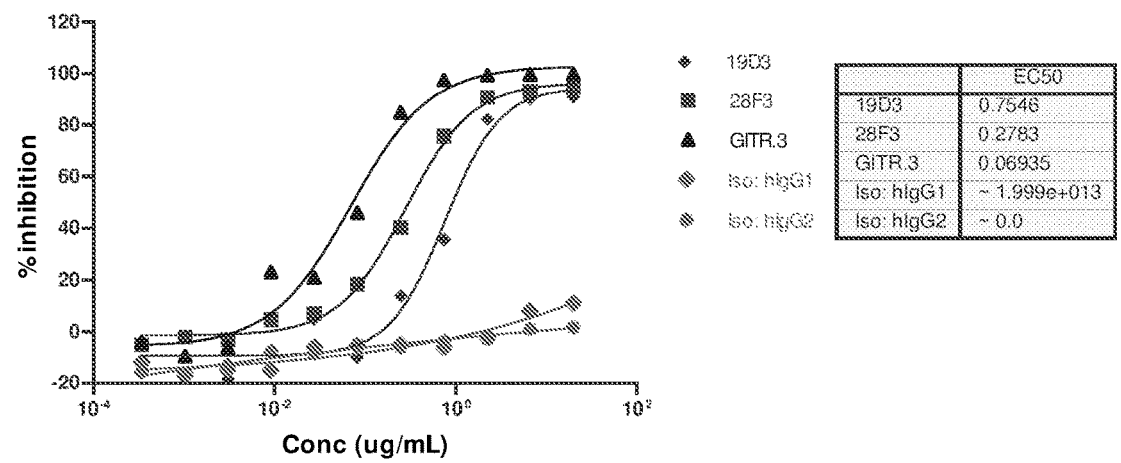

Example 5: Human Monoclonal Anti-GITR Antibodies Inhibit Binding of GITR-L to GITR To determine whether the HuMab anti-GITR antibodies inhibit the binding of GITR ligand to GITR, the mouse T cell hybridoma 3A9 cell line which ectopically expresses human GITR (GITR-3A9 cells) was pre-incubated with GITR mAbs at concentrations ranging from $10^{-4}$ μg/mL to 100 μg/mL, followed by incubation of GITR Ligand (R&D Systems #6987-GL) at a concentration of 10 ng/mL. The binding of GITR Ligand on cells was determined in a FACS-based assay using a PE conjugated anti-Hemagglutinin (HA) tag antibody, and samples were analyzed on a BD FACS Canto Flow Cytometer. As shown in FIGS. 34A and 34B, under these conditions, antibodies 19D3, 28F3, and GITR.3 (3C3) all blocked the binding of GITR-L to GITR-3A9 cells, with EC50 values of 0.7546, 0.2783, and 0.06934, respectively. Similar results were obtained with antibody 19H8.

Figure 34C:
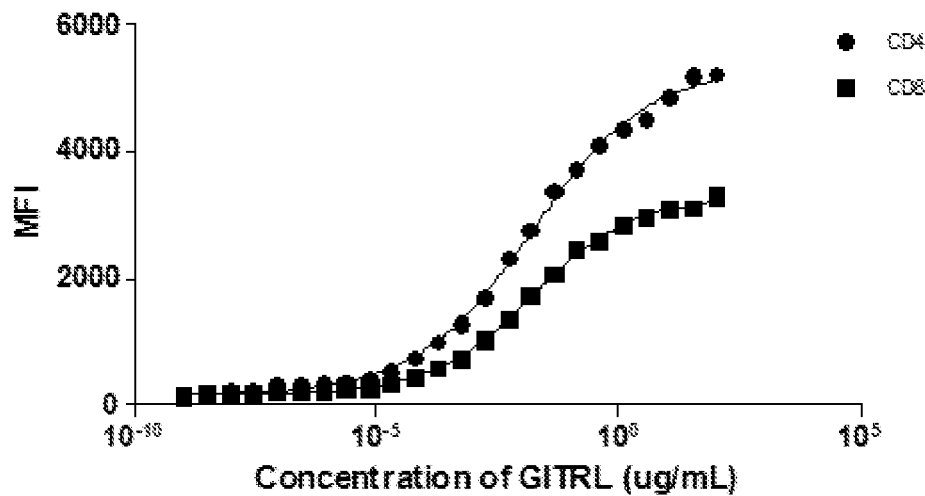
FIG. 34C shows binding of recombinant GITR-L to activated human CD4 and CD8 T cells.

Another set of experiments was conducted under different conditions to further evaluate the extent to which anti-GITR antibodies block GITR-L binding to GITR. In these experiments, a soluble, recombinant hGITR-L trimer at concentrations from $1.06 \times 10^{-9}$ to 100 mg/ml was added to activated human T cells and bound in a dose-dependent manner to CD4+ and CD8+ T cells with EC50 values of 0.016 ug/ml (FIG. 34C). The experiment was conducted as follows: Recombinant hGITR-L trimer (R&D Systems Cat. 6987-GL) at concentration from 1.06e-9 to 100 μg/mL was added to PHA-activated T cells. After a 30-minute primary incubation, cell-bound GITR-L was detected using PE conjugated anti-HA tag (Miltenyi Cat. 120-002-687). The samples were acquired on a FACS Canto Flow Cytometer (BD, San Jose) and analyzed with FlowJo software (Tree Star, Inc, Ashland, Oreg.).

Figure 34D:
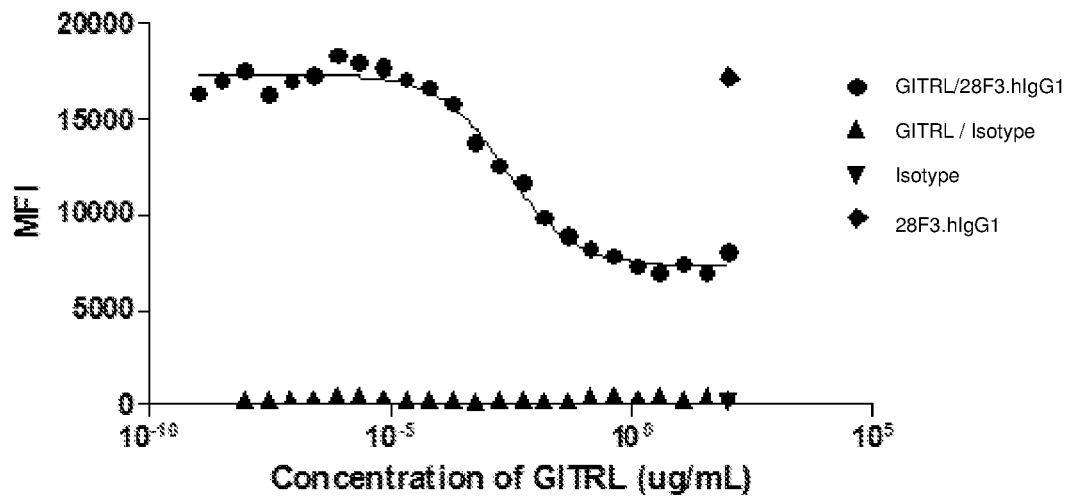
FIG. 34D shows that GITR-L partially blocks binding of 28F3-hIgG1 to activated human CD4+ T Cells. The binding of 28F3-hIgG1 at a fixed concentration of 0.5 µg/mL to activated T cells was partially blocked by pre-bound GITR-L with an IC50 of 0.0024 µg/mL.

Pre-binding of rhGITR-L at concentrations from $1.06 \times 10^{-9}$ to 100 ug/ml on activated T cells blocked the subsequent binding of 0.5 ug/ml 28F3-hIgG1 (approximately 90% of saturation) with an IC50 of 0.0024 ug/ml. Since at 100 ug/ml the MFI did not go to baseline (the IgG control), the inhibition was partial (FIG. 34D). The experiment was conducted as follows: PHA-activated T cells were first treated with 24-point, 3-fold titration of recombinant GITR-L trimer (R&D Systems 6987-GL), starting at 100 μg/mL, for 30 minutes. 28F3-hIgG1 was added subsequently at a fixed concentration of 0.5 μg/mL to the cell mixture, which was subjected to another 30-minute of incubation. Cell-bound 28F3-hIgG1 was detected using PE conjugated secondary antibody against human IgG Fc (Jackson ImmunoResearch Cat. 109-116-098). An unrelated hIgG1 Ab was used as an isotype control for 28F3-hIgG1 while a sample without pre-incubation of GITR-L was included to show the binding of 28F3-hIgG1 in the absence of blocking. The samples were acquired on a FACS Canto Flow Cytometer (BD, San Jose) and analyzed with FlowJo software (Tree Star, Inc, Ashland, Oreg.).

Figure 34E:
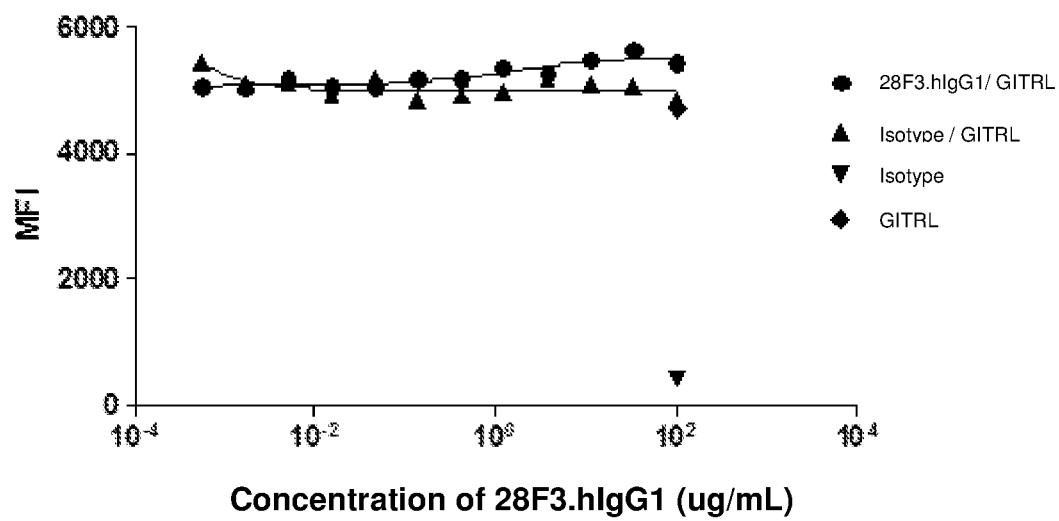
FIG. 34E shows that 28F3-hIgG1 does not block the binding of 0.6 µg/ml of GITR-L to activated human T cells. When GITR-L was added to CD4+ T cells at 0.6 mg/mL, approximately 90% of saturation, pre-bound 28F3-hIgG1 was unable to block GITR-L ranging from 100 mg/mL to 0.00056 mg/mL.
Figure 34F:
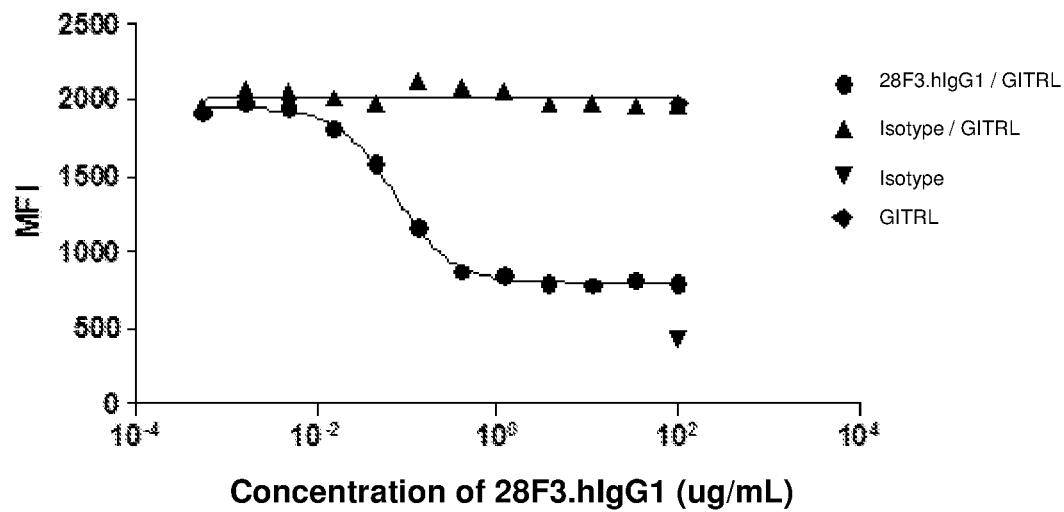
FIG. 34F shows that 28F3-hIgG1 partially blocks the binding of 0.02 µg/ml of GITR-L to activated human T cells. The binding of GITR-L at a fixed concentration of 20 ng/mL to activated T cells was partially blocked by pre-bound 28F3-hIgG1 with an IC50 of 0.075 µg/mL.

When activated T cells were pre-incubated with 28F3-hIgG1 at concentrations ranging from $1.06 \times 10^{-9}$ to 100 ug/ml, the binding of GITR-L at 0.6 ug/ml (approximately 90% saturation) was not affected (FIG. 34E). However, when GITR-L was added at a lower concentration of 20 ng/ml, near its EC50, its binding was partially blocked by pre-bound 28F3-hIgG1 with an IC50 of 0.076 mg/ml (FIG. 34F). The experiments were conducted as follows: PHA-activated T cells were pre-incubated with 28F3-hIgG1 at concentrations ranging from 0.00056 to 100 μg/mL, followed by the addition of 0.6 ug/ml or 20 ng/mL GITR-L. Cell-bound GITR-L was detected with PE conjugated anti-HA tag. An unrelated hIgG1 was included as an isotype control for 28F3-hIgG1 and a sample without primary antibody was used to show the binding of GITR-L without blocking. The samples were acquired on a FACS Canto Flow Cytometer (BD, San Jose) and analyzed with FlowJo software (Tree Star, Inc, Ashland, Oreg.).

These data show 28F3-hIgG1 is a partial ligand blocker which may allow for some in vivo engagement of GITR by GITR-L.

Example 6: All Anti-GITR Antibodies Bin into One Group

Antibody binning experiments were conducted with the following anti-human GITR antibodies: 28F3, 18E10, 19D3, 14E3, 8A6, 9G7, 3C3, and 6G10.

Anti GITR antibodies were immobilized onto Sensor Chip CM5 chip (Series S, GE Healthcare CAT # BR-1005-30) surfaces, flowcell2, flowcell3 & flowcell4 (5000 RUs), and flowcell1 was used as a negative control. The antibodies were diluted to 120 μg/mL (2×) at starting concentration. A series of dilutions were made by diluting 1:3 concentration of antibody with buffer for eight different concentrations (120 μg/ml-0.0 μg/ml, 2×) to obtain a titration curve. Each antibody concentration series was divided into two halves. In the first half of the concentration series, 40 nM (2×) GITR antigen (rHGITR/Fc CAT #689-GR) was added to make the final concentration series (60 μg/ml-0.0 μg/ml) and 20 nM of final antigen concentration in each well. In the second half of the concentration series, in place of antigen, buffer was added to have the antibody diluted to the same concentration, and this half was treated as the blank. Complexes were incubated for 2 hours. 40 μL complexes were injected on the antibody coated surface at a 30 μL/min flow rate. A Biacore T200 instrument was used and the running buffer was HBE-EP, GE Healthcare CAT #BR-1001-88, Filtered degassed, 0.01M HEPES, pH7.4, 0.15 NaCl, 3 Mm EDTA, 0.005% Surfactant P20. The surface was regenerated with 25 mM NaOH (Order code: BR-1003-58, GE Healthcare) at 100 μL/min for 5 seconds. The data was analyzed using Microsoft Excel where the concentration series of antibodies were plotted against the corresponding response unit to obtain titration curves.

The results indicate that all tested antibodies bin into one group, indicating that they all bind to a similar region of the extracellular region of human GITR.

Example 7: Anti-GITR Antibodies Bind to a Conformational Epitope

This Example shows that anti-GITR antibodies 28F3 and 3C3 bind to non denatured human GITR, but not to the denatured human GITR, and that binding is not affected by N- or 0-linked glycosylation.

Figure 35A:
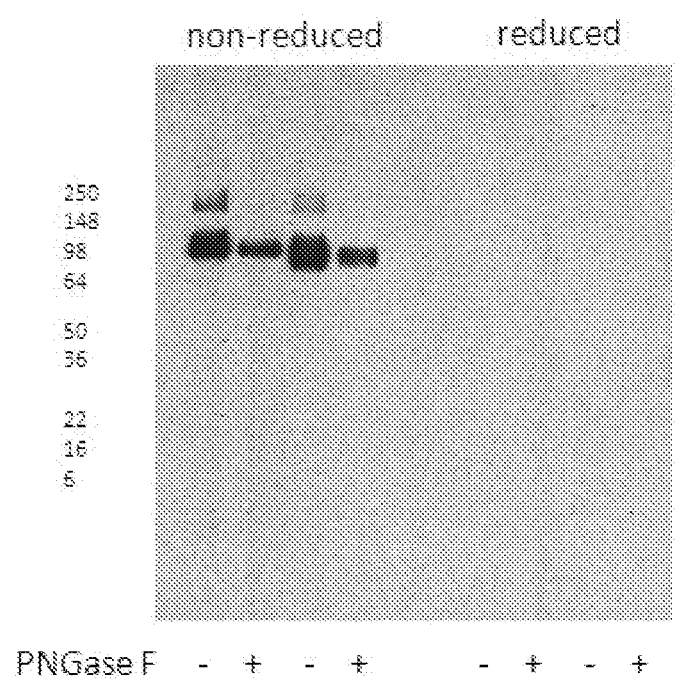
FIG. 35A shows a Western blot demonstrating that the anti-GITR antibody 28F3 binds to native, but not to denatured, human GITR, and that binding is not affected by the presence or absence of N-linked glyosylation. A "+" sign indicates samples treated with PNGase F to remove N-linked glycosylation.
Figure 35B:
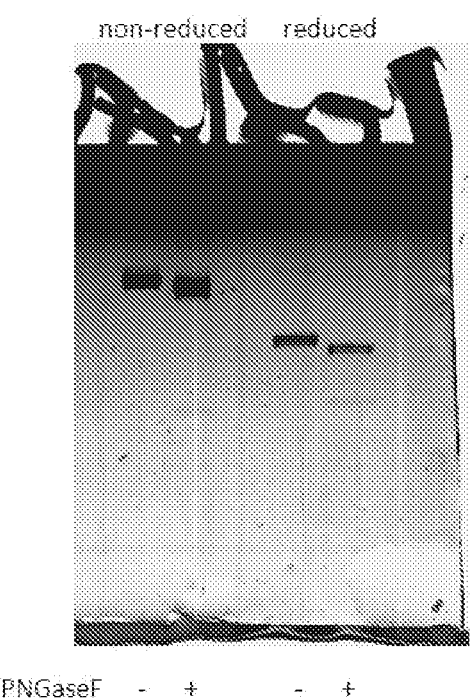
FIG. 35B is a Coomassie blue stained gel showing the presence of all forms of human GITR before transfer onto the nitrocellulose for the Western blot analysis.

Binding of anti-GITR antibodies to native or denatured GITR that has N-linked glycosylation or not was determined as follows. Samples of native (i.e., non denatured) and denatured human GITR were incubated with or without the enzyme N-glycanase PNGase F at 37° C. in PBS overnight to remove the N-glycosylation. The denaturation of GITR was done by reduction at 37° C. in 50 mM dithiothreitol and 4 M guanidine hydrochloride for 45 minutes, and then followed by alkylation in 100 mM iodoacetamide for 20 minutes at room temperature. Samples of native human GITR with or without N-linked glycosylation were subjected to SDS gel electrophoresis, and samples of denatured GITR with or without N-linked glycosylation were subjected to denaturing SDS gel electrophoresis. The proteins were transferred onto nitrocellulose membrane for Western blot analysis. The membrane was incubated with the 28F3 antibody. Binding was detected by incubation with a secondary antibody conjugated with horseradish peroxidase (HRP labelled) specific to anti-human IgG heavy and light chains (Jackson ImmunoResearch Laboratories, Inc.), and followed by luminescence detection captured on film. The results, which are shown in FIG. 35, indicate that the anti-GITR Ab 28F3 binds only to native GITR, and not to the denatured form, and that the presence or absence of glycosylation does not affect binding. Similar results were obtained with anti-GITR antibody 3C3.

Thus, anti-GITR antibodies 28F3 and 3C3 bind to an epitope that is conformational and independent of N-linked and O-linked glycosylation.

Example 8: Binding Patterns of 28F3 and 3C3 to Native Human GITR Peptides

Figure 36A:
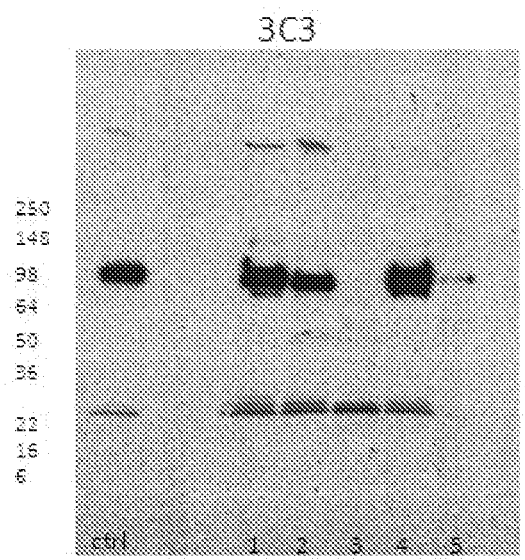
FIG. 36A-36B shows the binding of the 28F3 and 3C3 antibodies to native GITR fragments generated by digestion with Endoproteinase Arg-C(1), Endoproteinase Lys-C(2), Trypsin (3), Endoproteinase Glu-C(4), or Endoproteinase Asp-N (5).
Figure 36B:
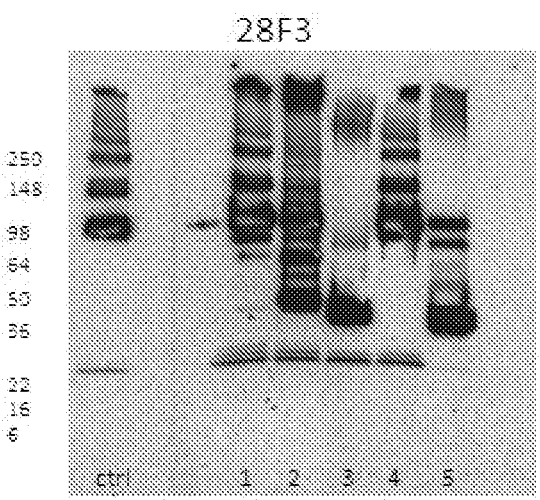

The pattern of binding of 28F3 and 3C3 to human GITR was investigated by testing the binding of these antibodies to peptides generated from native human GITR by SDS-PAGE and Western blot analysis. The experiment was conducted as follows. First, native human GITR was subjected to proteolysis by incubation with Endoproteinase Arg-C, Endoproteinase Lys-C, Trypsin, Endoproteinase Glu-C or Endoproteinase Asp-N at a 2% w/w ratio at 37° C. in PBS for 5 hours without the presence of denaturing reagents. The entire reaction mixture, 2 µg from each digest, was then subjected to non-denaturing SDS-PAGE electrophoresis, and transferred onto nitrocellulose for Western blot analysis. The Western blots were then incubated with 28F3 or 3C3 antibody, and the binding detected by detected by incubation with a secondary antibody conjugated with horseradish peroxidase (HRP labelled) specific to anti-human IgG heavy and light chains (Jackson ImmunoResearch Laboratories, Inc.), and followed by luminescence detection captured on film. The results, which are shown in FIG. 36, indicate that binding pattern of 28F3 and 3C3 is different, suggesting that these antibodies do not bind to exactly the same region of human GITR.

Figure 37:
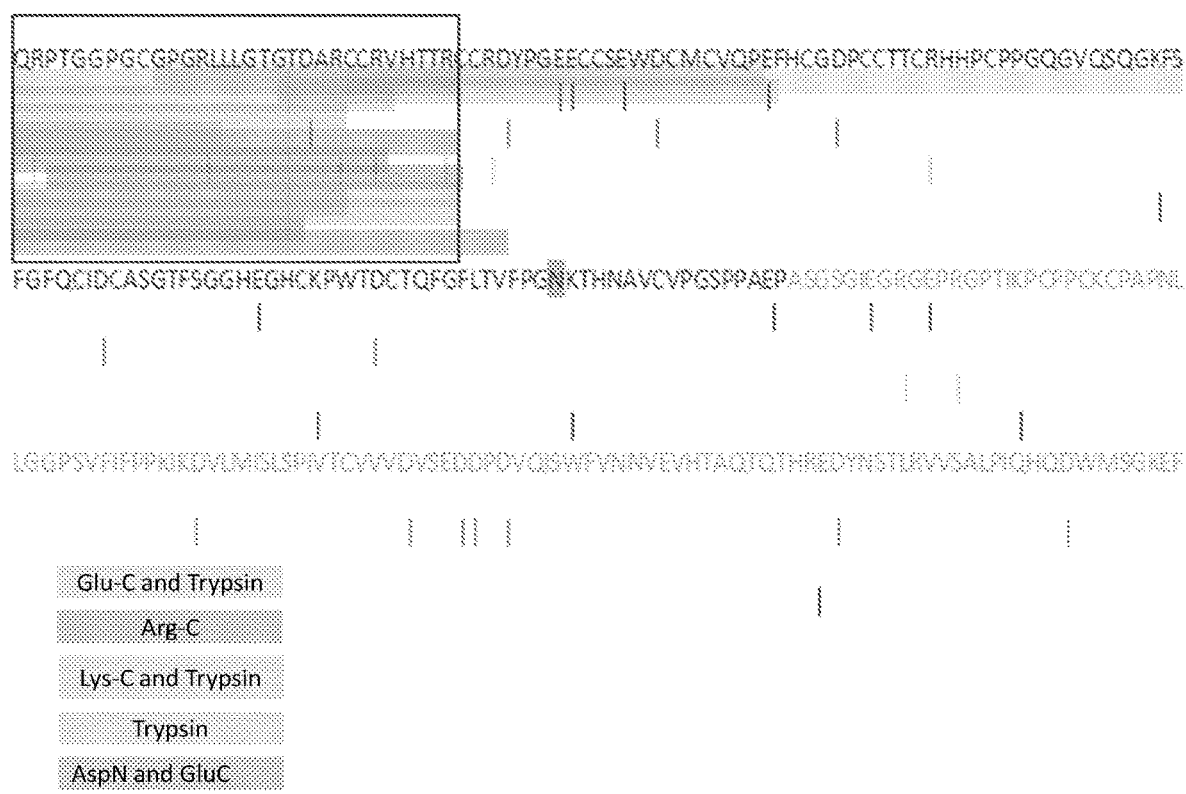
FIG. 37 shows a heat map view of the anti-GITR antibody 28F3 binding to human GITR peptide fragments generated from digestion of a native human GITR protein with Endoproteinase Glu-C and Trypsin ("Glu-C and Trypsin"), Endoproteinase Arg-C("Arg-C"), Endoproteinase Lys-C and Trypsin ("Lys-C and Trypsin"), Trypsin, or Endoproteinase Asp-N and Endoproteinase Glu-C("AspN and GluC"), identifying the location of the epitope to which the 28F3 antibody binds (boxed region). The amino acid sequence of the mature extracellular domain of human GITR is shown in dark grey and the sequence of mouse Fc, linked C-terminally to it is shown in light grey.

Example 9: Anti-GITR Antibody 28F3 Binds to the N-Terminus of the Extracellular Domain of Human GITR The location of the region on human GITR to which 28F3 binds was determined by testing the binding in solution of the antibody to various non-denatured fragments of human GITR. The experiment was conducted as follows: Human GITR peptide fragments were generated by incubation of human GITR with Endoproteinase Arg-C, Endoproteinase Lys-C, Trypsin, Endoproteinase Glu-C or Endoproteinase Asp-N at a 2% w/w ratio at 37° C. in PBS for five hours without the presence of denaturing reagents. The peptide mixture was then incubated with anti-GITR Ab beads in PBS at room temperature for two hours. Some samples were subjected to in situ secondary cleavage by incubation with a different enzyme in PBS for an hour. Unbound peptides were removed by washing the anti-GITR Ab beads twice with PBS. Peptides that bound onto anti-GITR Ab 28F3 were eluted with 2% formic acid, and then subjected to sequence identification by LC-MS. The results, which are shown as a heatmap in FIG. 37, indicate that 28F3 binds to a conformational epitope within the following N-terminal amino acid stretch:

QRPTGGPGCGPGRLLLGTGTDARCCRVHTTRCCRDYPGE, (SEQ ID NO: 215)

which corresponds to amino acid residues 1 to 39 of the mature human GITR (SEQ ID NO: 4) or within the shorter fragment QRPTGGPGCGPGRLLLGTGTDARC-CRVHTTR (SEQ ID NO: 370).

Example 10: O-Linked Glycosylation on Human GITR does not Interfere with Binding of 28F3

There is no known or documented O-linked glycosylation on the extracellular domain of human GITR. However, residues T18 and T20 of SEQ ID NO: 215 contain an O-glycosylation consensus sequence. These residues are underlined in the epitope sequence: QRPTGGPGCGPGRLLLGTG TDARCCRVHTTRCCRDYPGE (SEQ ID NO: 215). Therefore, it was determined whether O-linked glycosylation affects the binding of 28F3 to human GITR.

Figures 38A, 38B, 38C, 38D, 38E:
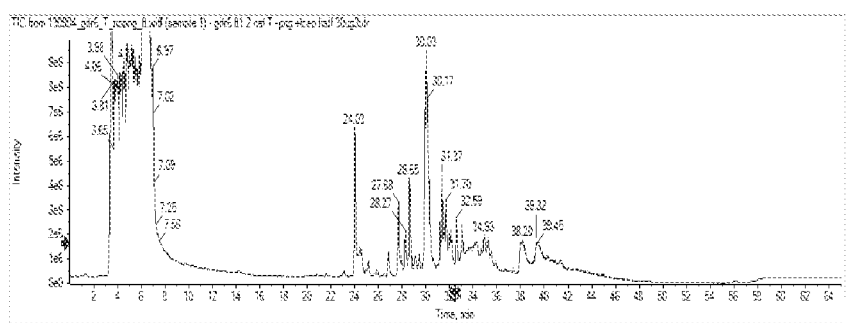
FIG. 38A shows the peptides in the flow-through fraction, after incubation of 28F3 coated beads to peptides resulting from a trypsin digestion of native human GITR.
FIG. 38B shows two main 28F3 bound peptides (indicated by an asterisk).
FIG. 38C shows the identification by LC-MS of the first of the two peaks in FIG. 34B as corresponding to the N-terminal peptide having the sequence shown and lacking O-linked glycosylation.
FIG. 38D shows the identification by LC-MS of the second of the two peaks in FIG. 34B as corresponding to the N-terminal peptide having the sequence shown and having an O-linked glycosylation on T20.
FIG. 38E shows the GITR peptide remaining following in situ digestion with endoproteinase Asp-N of a longer peptide that was incubated together with 28F3.

Binding of 28F3 to a glycosylated or non-glycosylated peptide consisting of SEQ ID NO: 215 was conducted as follows: Partially glycosylated and non-glycosylated N-terminal peptides of human GITR were generated by proteolysis of the intact native human GITR extracellular domain linked to mouse Fc. A non-glycosylated GITR peptide consisting of amino acid residues 1 to 39 of SEQ ID NO: 215 was also generated by organic synthesis. Procedures for binding of 28F3 to the peptides were described in the previous section (using 28F3 coated beads). As shown in FIG. 38B, two peptides were found to bind to the 28F3 coated beads, and these were identified by LC-MS as being the N-terminal peptide without O-linked glycosylation (FIG. 38A) and the other is the same N-terminal peptide with O-linked glycosylation on T18 and/or T20 of SEQ ID NO: 215 (FIG. 38D).

Thus, 28F3 binds to the N-terminal region of human GITR regardless of whether it has an O-linked sugar on amino acid T18 and/or T20.

Example 11: Binding of Anti-GITR Antibody 28F3 to a 20-Mer

As part of the experiment described in the previous Example, a synthetic peptide having SEQ ID NO: 215 that does not have any O-linked glycoslylation was first bound onto the 28F3 coated beads, and then further cleaved by in situ digestion with endoproteinase Asp-N. The remaining peptide, consisting of the amino acid sequence QRPTGGPGCGPGRLLLGTGT (SEQ ID NO: 216) and containing the amino acid residues T18 and T20 without the O-linked glycosylation, bound to 28F3 (FIG. 38E). Thus, 28F3 binds to a 20-mer consisting of SEQ ID NO: 216.

Example 12: Epitope Mapping by HDX-MS

The hydrogen/deuterium exchange mass spectrometry (HDX-MS) method probes protein conformation and conformational dynamics in solution by monitoring the rate and extent of deuterium exchange of backbone amide hydrogen atoms. The level of HDX depends on the solvent accessibility of backbone amide hydrogen atoms and protein hydrogen bonds. The mass increase of the protein upon HDX can be precisely measured by MS. When this technique is paired with enzymatic digestion, structure features at the peptide level can be resolved, enabling differentiation of surface exposed peptides from those folded inside. Typically, the deuterium labeling and subsequent quenching experiments are performed, followed by online pepsin digestion, peptide separation, and MS analysis.

Figure 39A:
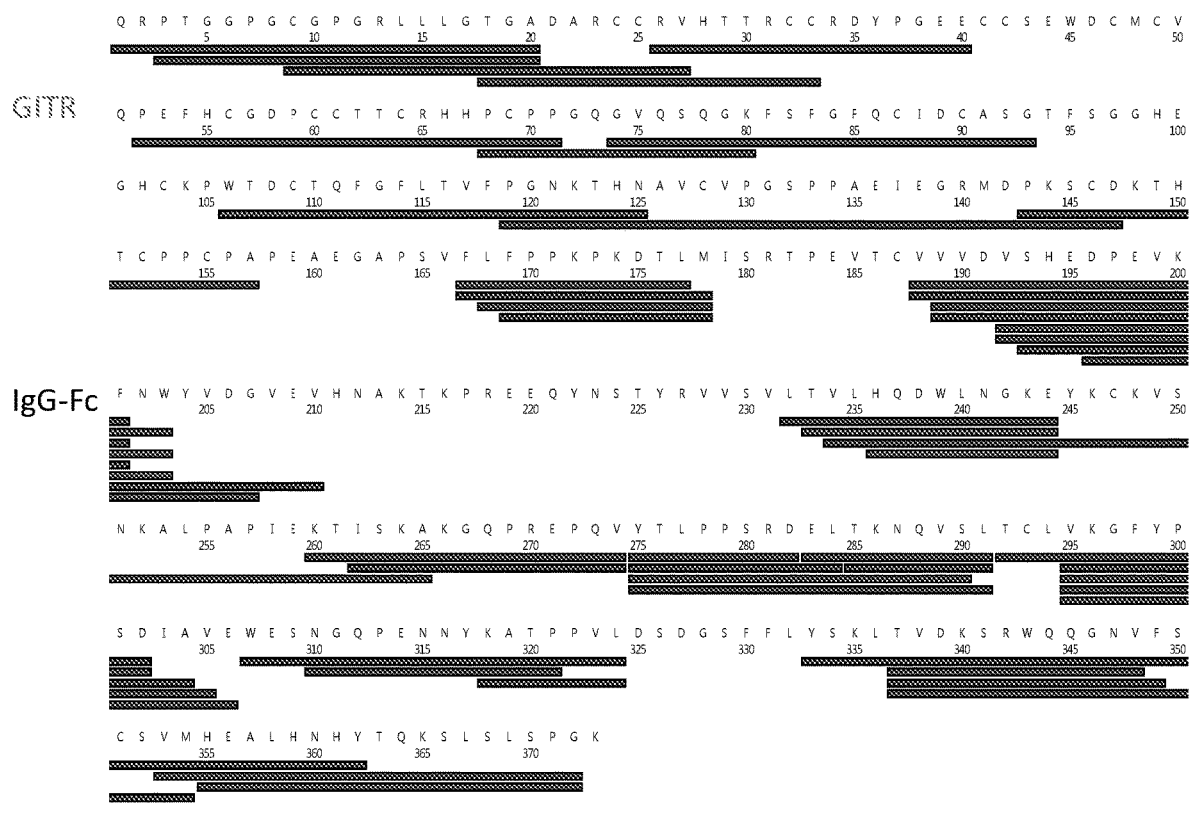
FIG. 39A shows a list of peptic peptides for recombinant human GITR/Fc and protein complex of recombinant human GITR/Fc and 28F3 IgG1, achieving a sequence coverage of 86% for the N-terminal region of GITR.

Prior to epitope mapping of 28F3.IgG1 mAb (having a heavy and light chain consisting of SEQ ID Nos: 17 and 19, respectively) in GITR by HDX-MS, non-deuteriated experiments were performed to generate a list of common peptic peptides for recombinant human GITR/Fc (R&D systems, 10 μM, which contains the amino acid substitution T20A) and protein complex of recombinant human GITR/Fc and 28F3.IgG1 mAb (1:2 molar ratio, 10 μM & 20 μM), achieving a sequence coverage of 86% for GITR N-terminal region (FIG. 39A). In this experiment, 10 mM phosphate buffer (pH 7.0) was used during the labeling step, followed by adding quenching buffer (200 mM phosphate buffer with 4M GdnCl and 0.5M TCEP, pH 2.5, 1:1, v/v). For epitope mapping experiments, 5 μL of each sample (GITR/Fc or GITR/Fc with 28F3.IgG1 mAb (1:2 molar ratio)) was diluted into 55 μL of D$_2$O buffer (10 mM phosphate buffer, D$_2$O, pD 7.0) to start the labeling reactions at room temperature. The reactions were carried out for different periods of time: 20 sec, 1 min, 10 min, 60 min and 240 min. By the end of each labeling reaction period, the reaction was quenched by adding quenching buffer (1:1 v/v) and 50 μL of quenched sample was injected into Waters HDX-MS system for analysis. The observed common peptic peptides were monitored for their deuterium uptake levels in the absence/presence of 28F3.IgG1 mAb.

Figure 39B:
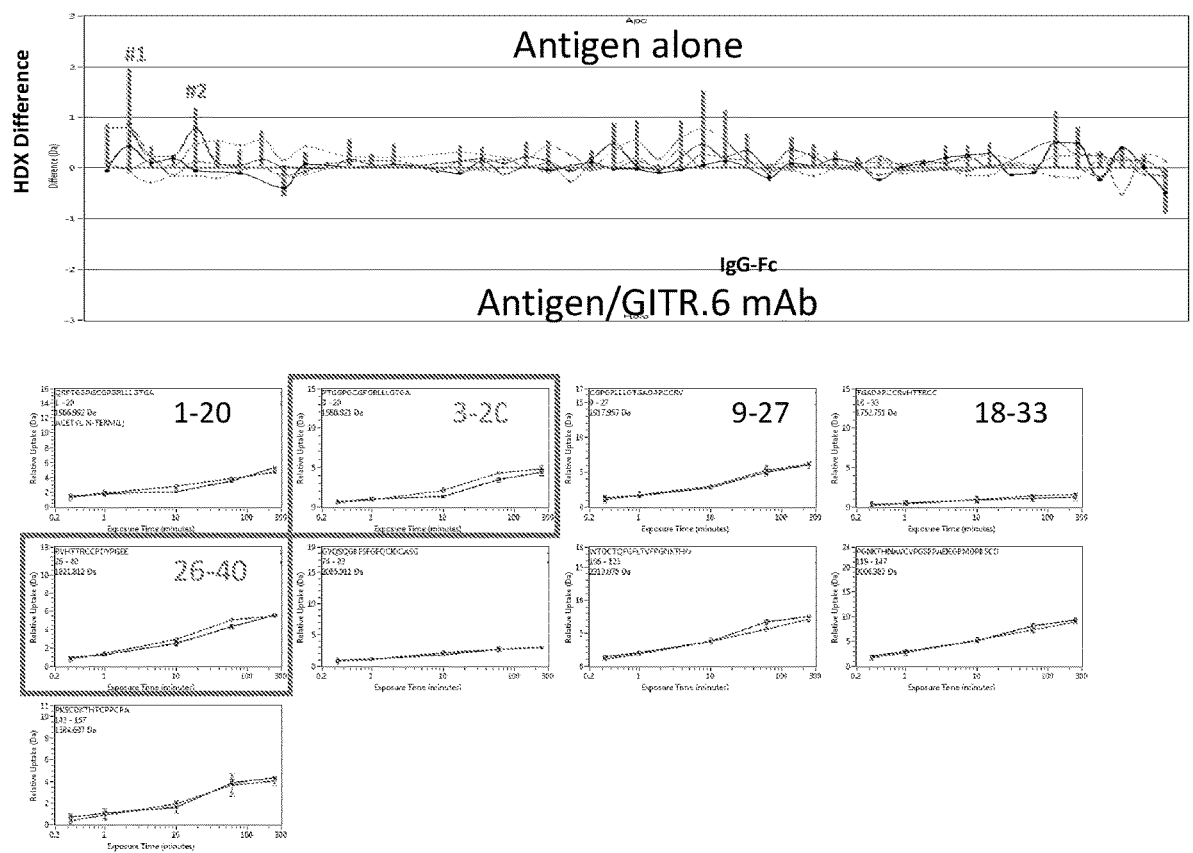
FIG. 39B shows the deuterium uptake levels by HDX mass spectrometry (MS) in the absence/presence of the 28F3 IgG1 mAb ("GITR.6").

Experimental data shown in FIGS. 39B and 39C obtained from HDX-MS measurements on 28F3.IgG1 mAb in GITR indicate that 28F3.IgG1 mAb has a discontinuous epitope comprised of (or within) two peptide regions in GITR N-terminal region:

```
Peptide region 1:
                          (SEQ ID NO: 217)
PTGGPGCGPGRLLLGTGA Peptide region 2:
                          (SEQ ID NO: 218)
CRDYPGEE
```

Based on changes of relative deuterium uptake levels, the two peptide regions can be ranked as region 1>2 with region 1 having the most significant changes in deuterium uptake, and with region 2 being statistically significant.

Example 13: Anti-GITR Antibodies Induce IL-2 and IFN-γ Secretion from T Cells Anti-GITR antibodies were tested for their ability to enhance T cell activity in vitro by measuring the amount of IL-2 and IFN-γ secreted by T cells incubated with the antibodies.

Figure 40:
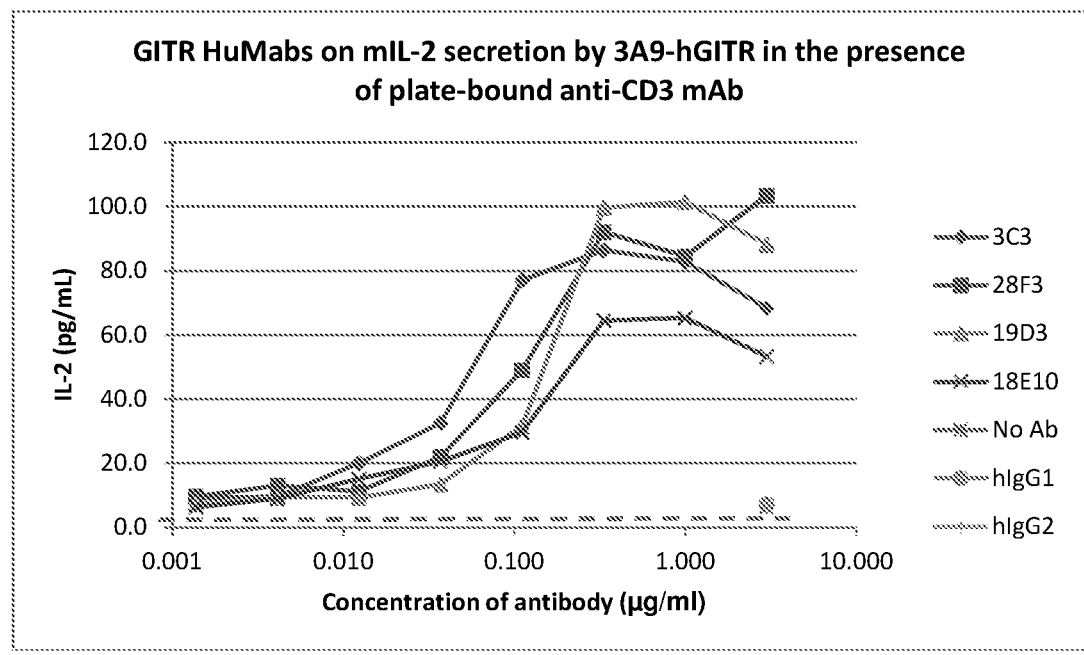
FIG. 40 shows the effects of various agonist anti-GITR antibodies on IL-2 secretion by 3A9-hGITR cells in the presence of plate-bound anti-CD3 antibodies.

Mouse T cell hybridoma 3A9 cell line which ectopically expresses human GITR (3A9-hGITR) was cultured on anti-CD3 monoclonal antibody-coated plates in the presence of increasing amounts of the 19D3, 18E10, and 28F3 antibodies. 5×10$^4$ 3 A9-hGITR cells were cultured on plates coated with 1 μg/ml anti-CD3 antibody (Clone 145-2C11; BD Biosciences), and treated with the indicated concentrations of antibodies for 24 hours. As shown in FIG. 40, antibodies 3C3 (GITR.3), 28F3, 19D3, and 18E10 all enhanced IL-2 secretion from T cells in a dose-dependent manner. As expected, control hIgG1 and hIgG2 antibodies did not increase IL-2 secretion from 3A9-hGITR cells.

Figure 41A:
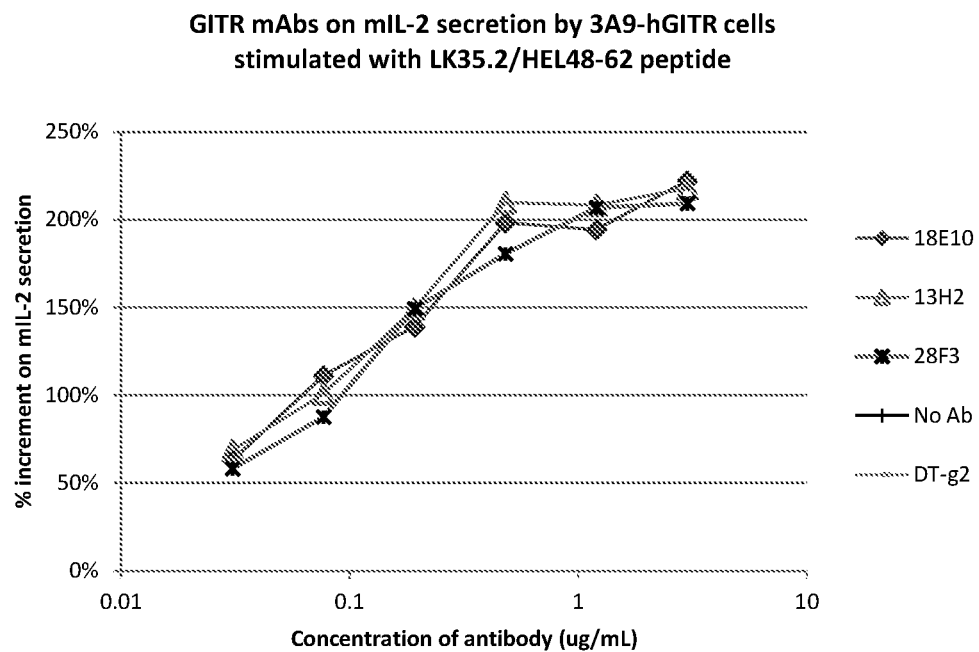
FIG. 41A shows the effects of agonist anti-GITR antibodies 18E10, 13H2 (same as 28F3), and 28F3 on IL-2 secretion by 3A9-hGITR cells activated by a specific antigen.
Figure 41B:
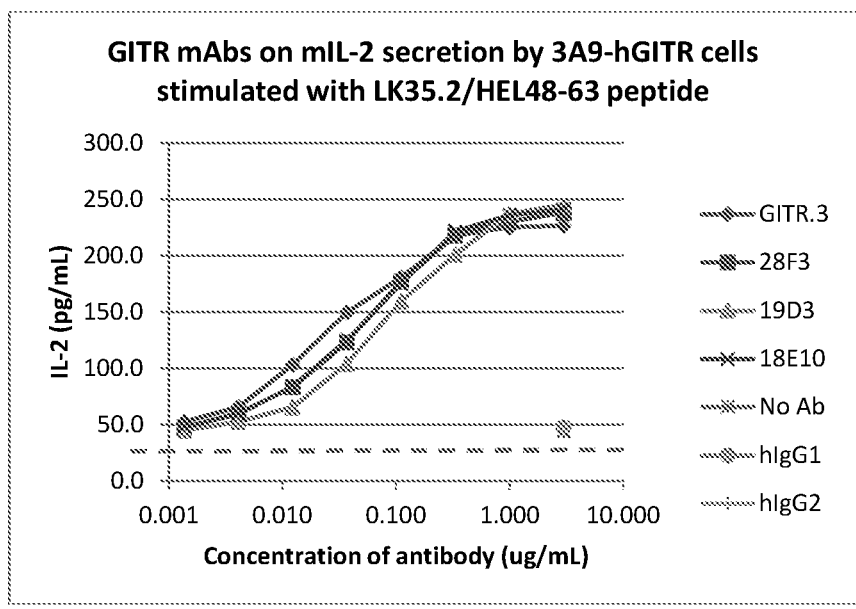
FIG. 41B shows the effects of agonist anti-GITR antibodies 3C3 (shown as "GITR.3"), 28F3, 19D3, and 18E10 on IL-2 secretion by 3A9-hGITR cells activated by a specific antigen.

Given that the anti-GITR antibodies enhanced IL-2 secretion from 3A9-hGITR cells in the presence of stimulatory CD3 signal, the ability of the antibodies to enhance IL-2 secretion from 3A9-hGITR cells activated by a specific antigen was tested. 5×10$^4$ 3 A9-hGITR cells were co-cultured with 2.5×10$^4$ LK35.2 antigen presenting cells in the presence of 0.4 μM HEL48-63 peptide and the indicated antibodies for 24 hours. As shown in FIGS. 41A and 41B, antibodies 18E10, 13H2 (same antibody as 28F3), 28F3, 3C3, and 19D3 enhanced IL-2 secretion from 3A9-hGITR cells in a dose-dependent manner.

In further experiments, the effect of 28F3 on IL-2 and IFN-γ secretion by T cells was tested on human donor T cells that were stimulated with anti-CD3scFv (OKT3) expressing CHO cells. The CHO cells expressed low levels of OKT3 to promote suboptimal stimulation to be able to observe agonism by anti-GITR antibodies. In one set of experiments, CD3+ T cells from a donor were stimulated with OKT3 expressing CHO cells and an anti-GITR antibody, and IFN-γ secretion was measured, and in a second set of experiments, CD4+ T cells from 2 donors (different from the donor of the CD3+ T cells) were stimulated with OKT3 expressing CHO cells and an anti-GITR antibody, and IL-2 and IFN-γ secretion was measured. The experiments were conducted as follows. Pan T cells were obtained from human PBMCs isolated from Ficoll gradient (Amersham Bioscience 17-1440-03) with Pan T cells isolation kit (Miltenyi #130-091-156) according to manufacturer's protocol. For experiments with CD4+ T cells, CD4+ T cells were obtained from human PBMCs (donors 1 and 2) with RosetteSep Human CD4+ T cell enrichment cocktail (StemCell Technology #15062) according to the manufacturer's protocol. CHO cells expressing anti-CD3scFv (OKT3) (CHO-OKT3) were washed twice with RPMI medium and subjected to irradiation with a dosage of 50K Rad. Cells were harvested and resuspended in culture medium (RPMI-1640 supplemented with 10% Fetal Bovine Serum, 2 mM L-glutamine, 55 nM β-Mercaptoethanol, 1 mM sodium pyruvate, and 100 U/mL Penicillin/streptomycin) at 2.5×10$^5$/mL. 2.5×10$^4$ CHO-OKT3 cells and 1×10$^5$ T cells were seeded per well in a 96-well TC grade flat-bottom plate (Costar). Cells were incubated with an 8-point, 3-fold titration of GITR antibody starting at 20 μg/mL. An unrelated hIgG1 was added at 20 μg/mL as an isotype control. A sample with cells only was included to show baseline activity without any treatment. Supernatant from each sample was harvested at day 2 for IL-2 measurement (only for assays with CD4+ T cells) (BD opt EIA Human IL-2 ELISA kit; BD Bioscience #555190) and at day 3 for IFN-γ measurement (BD optETA human IFN-g ELISA Kit; BD Bioscience #555142).

The results, which are shown in FIG. 42B-E, indicate a 28F3 dose dependent increase in IL-2 and IFN-γ secretion by CD4+ T cells from both donors.

Figure 42A:
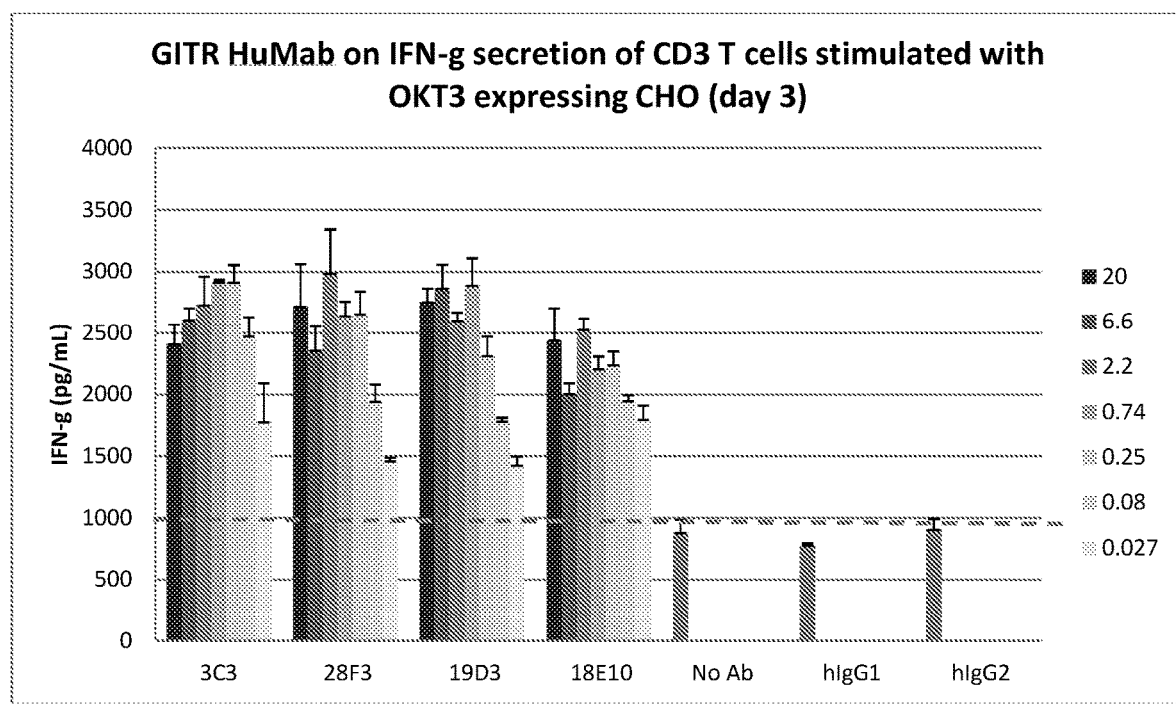
FIG. 42A shows the effects of various agonist anti-GITR HuMabs antibodies on interferon gamma (IFN-γ) secretion by T cells stimulated with CHO-OKT3 cells (i.e., CHO cells expressing OKT3 scfv).
Figure 42B:
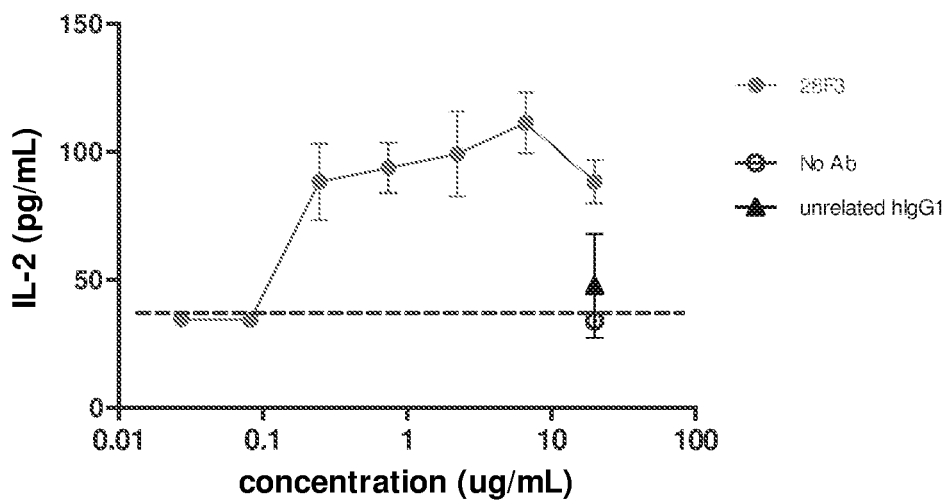
FIG. 42B shows the effects of the agonist anti-GITR antibody 28F3 on IL-2 secretion by CD4+ T cells stimulated with OKT3 expressing CHO cells, wherein the T cells are from a first donor.
Figure 42C:
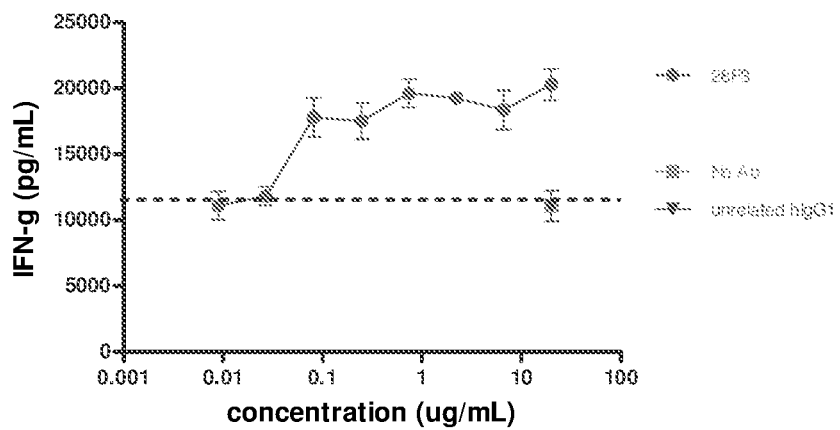
FIG. 42C shows the effects of the anti-GITR antibody 28F3 on IFN-γ secretion by CD4+ T cells stimulated with OKT3 expressing CHO cells, wherein the T cells are from the first donor.
Figure 42D:
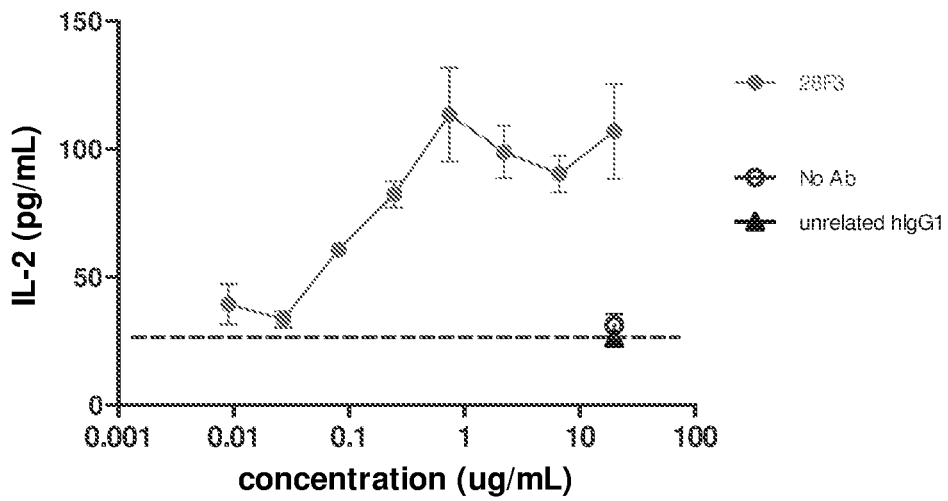
FIG. 42D shows the effects of the anti-GITR antibody 28F3 on IL-2 secretion by CD4+ cells stimulated with OKT3 expressing CHO cells, wherein the T cells are from a second donor.
Figure 42E:
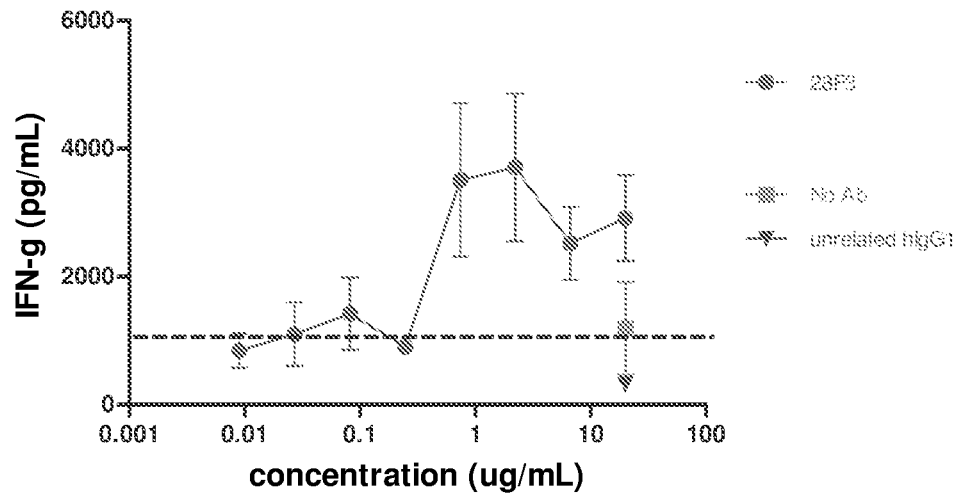
FIG. 42E shows the effects of the anti-GITR antibody 28F3 on IFN-γ secretion by CD4+ T cells stimulated with OKT3 expressing CHO cells, wherein the T cells are from the second donor.

Secretion of IFN-γ by donor T cells stimulated with other anti-GITR antibodies was also demonstrated. The assay was conducted as described above. As shown in FIG. 42A, the antibodies 28F3, 3C3, 19D3, and 18E10 all enhanced IFN-γ secretion from CD3+ T cells in a dose-dependent manner, with antibodies 28F3 and 3C3 showing the largest effect of the tested antibodies.

In another experiment, T cell proliferation in the presence of anti-GITR antibodies, in particular, 28F3, was observed in mixed lymphocyte reactions (MLRs).

Collectively, these data indicate that antibodies 18E10, 19D3, and 28F3 function as agonistic anti-GITR antibodies that enhance secretion of cytokines from T cells.

Figure 43:
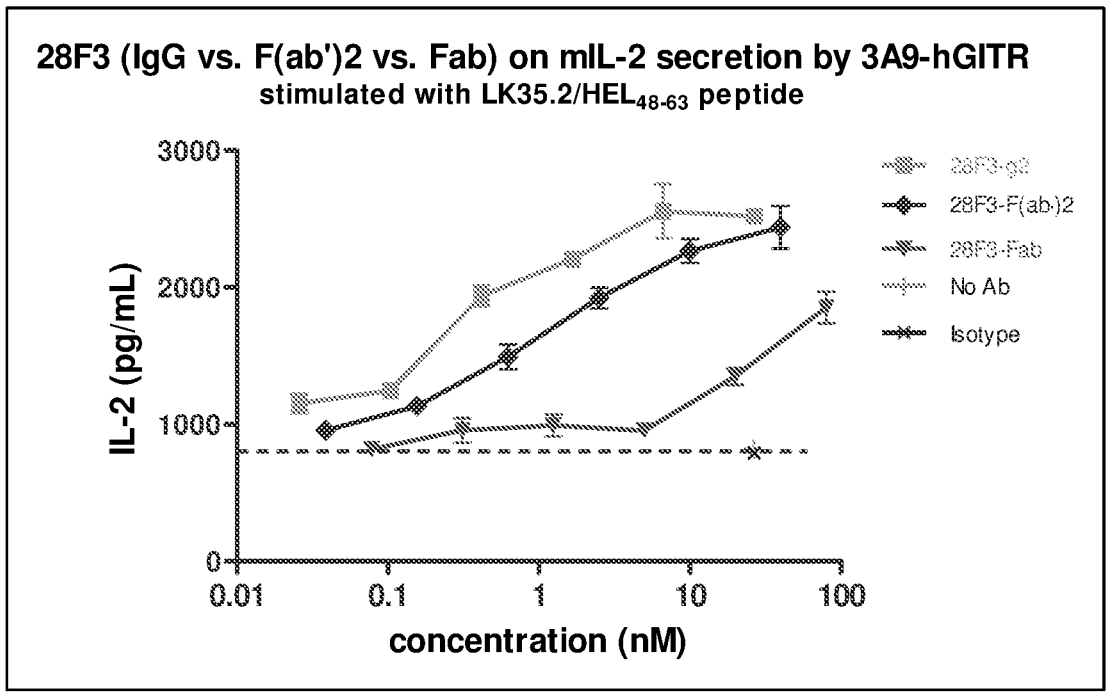
FIG. 43 shows the effects of the anti-GITR antibody 28F3 (IgG2), 28F3-F(ab')2 fragment, and 28F3-Fab on IL-2 secretion by 3A9-hGITR cells stimulated with LK35.2 cells in the presence of HEL48-63 peptide.

Example 14: Anti-GITR Antibodies Activate T Cell Responses Independently of FcR Interaction in Vitro It has been reported that agonistic anti-TNFR antibodies require FcγRIIB co-engagement for their in vivo activity (Li et al., *Cell Cycle* 2012; 11:3343-3344). To determine whether this requirement also extends to anti-GITR antibodies, 3A9-hGITR cells were co-cultured with LK35.2 cells and the HEL48-63 peptide as described in Example 13, treated with the full length anti-GITR antibody 28F3 (hIgG2), F(ab')2 fragment of 28F3 or Fab fragment of 28F3, and assessed for mIL-2 production. The results, which are set forth in FIG. 43, show that both full length 28F3 and the F(ab')2 fragment of 28F3 enhanced mIL-2 production, although the Fab fragment of 28F3 had a weaker effect, suggesting that bivalent, but not monovalent engagement contributes to the effect of the anti-GITR antibody 28F3. These results collectively suggest that although FcγRIIB co-engagement is not required for the T cell-enhancing effects of agonistic anti-GITR antibodies in vitro, engaging the FcγRIIB receptor may potentiate agonist activity. Anti-GITR antibodies can be engineered to increase binding to the FcγRIIB receptor to increase their agonism.

Example 15: Anti-GITR Antibody 28F3 Labels Lymphocytes in Human Tonsil

Figure 44:
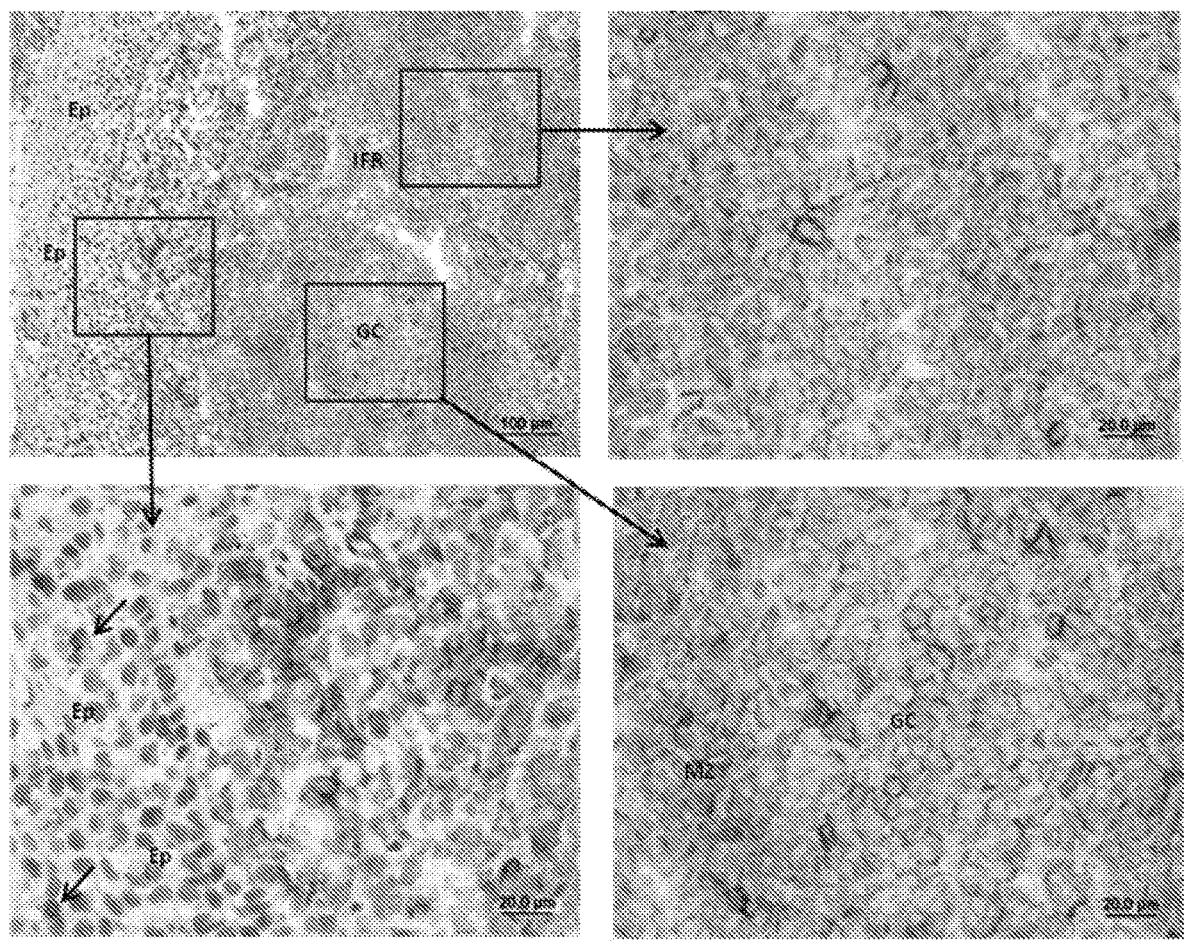
FIG. 44 shows immunohistochemistry of human tonsil specimens with the monoclonal antibody 28F3-FITC.

To determine which tissues express GITR, the anti-GITR antibody 28F3 was used for immunohistochemical detection of GITR in various tissues. No specific staining in non-lymphoid tissues was found (including heart, liver, lung, kidney, skin, peripheral nerve, thyroid, testis, prostate). Positive staining was only observed in scattered subsets of lymphocytes and/or mononuclear cells in lymphoid (including tonsil, spleen, and thymus) and lymphoid-rich (lamina propria of colon, stomach, uterus) tissues. Staining in the tonsil is shown in FIG. 44. Positive staining was observed in scattered lymphocytes in the inter/para-follicular region and the germinal center. Scattered clusters of mononuclear cells (beneath the epithelium) and epithelium-infiltrating lymphocytes also stained positive.

Example 16: Anti-Tumor Activity of Variant Anti-GITR Isotypes in MC38 Tumor Model DTA-1 is an agonistic rat anti-mouse GITR antibody (Shimizu et al., 2002; eBioscience, San Diego, Calif.). This IgG2b antibody has been shown to modulate both $T_{regs}$ and $T_{effs}$ during treatment of B16 melanoma. In addition, GITR expression by both $T_{effs}$ and $T_{regs}$ was needed for the full effects of DTA-1. Cohen et al. (2010) suggested that while GITR ligation by DTA-1 does not globally abrogate $T_{reg}$ suppressive activity, it impairs $T_{reg}$ tumor infiltration and leads to loss of Foxp3 expression within intra-tumor $T_{regs}$, implying a localized abrogation of suppression. The net result is an augmented intra-tumor $T_{eff}$:$T_{reg}$ ratio and greater $T_{eff}$ activation and function within the tumor. DTA-1 blocks the interaction between GITR and GITR ligand (GITRL) and the soluble antibody is effective in promoting a cell response in vitro. It is also efficacious in various tumor models in inhibiting tumor growth (see, e.g., Turk et al., 2004; Cohen et al., 2010).

a) Experiment MC38 #1

The anti-tumor activity of the different anti-GITR (DTA-1) isotypes was assessed in a staged MC38 colon adenocarcinoma tumor model. C57BL/6 mice were each subcutaneously injected with 2×10⁶ MC38 tumor cells. After 7 days, the mice were randomized into 5 treatment groups and test antibodies were administered IP on Days 7, 10 and 14 at 200m per dose in a volume of 200 µl as follows: Group 1: mouse IgG1 control (IgG); Group 2: anti-GITR rat IgG2b Ab (DTA-rG2b); Group 3: anti-GITR mouse IgG1 Ab (DTA-mG1); and Group 4: anti-GITR mouse IgG 2a Ab (DTA-mG2a). Tumors and spleens were harvested on Day 15.

Figure 45A:
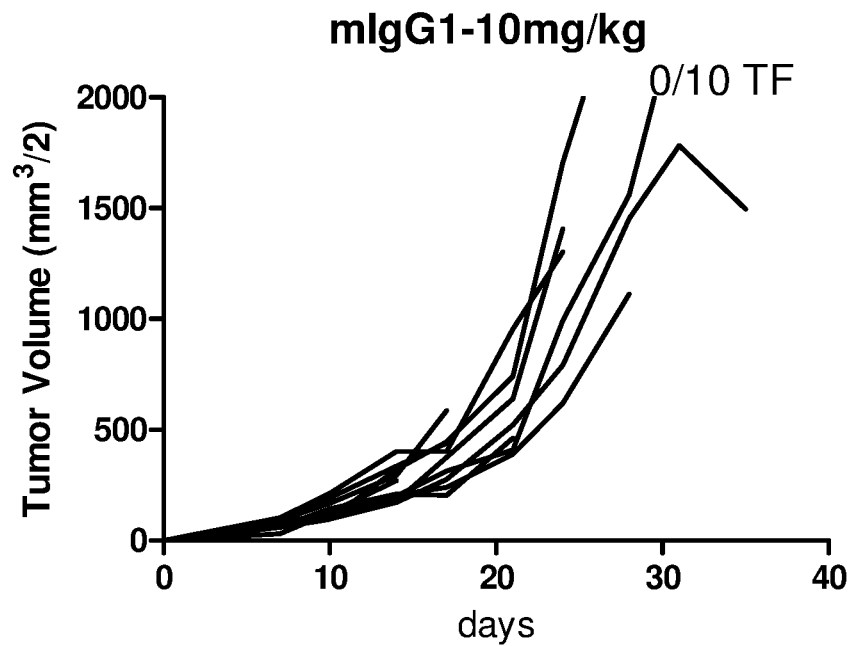
FIG. 45A-45D show the effects of different isotypes of the rat anti-mouse GITR antibody, DTA-1, on anti-tumor activity measured by changes in the tumor volumes in individual mice treated with these isotypes in a MC38 colon adenocarcinoma model.
Figure 45B:
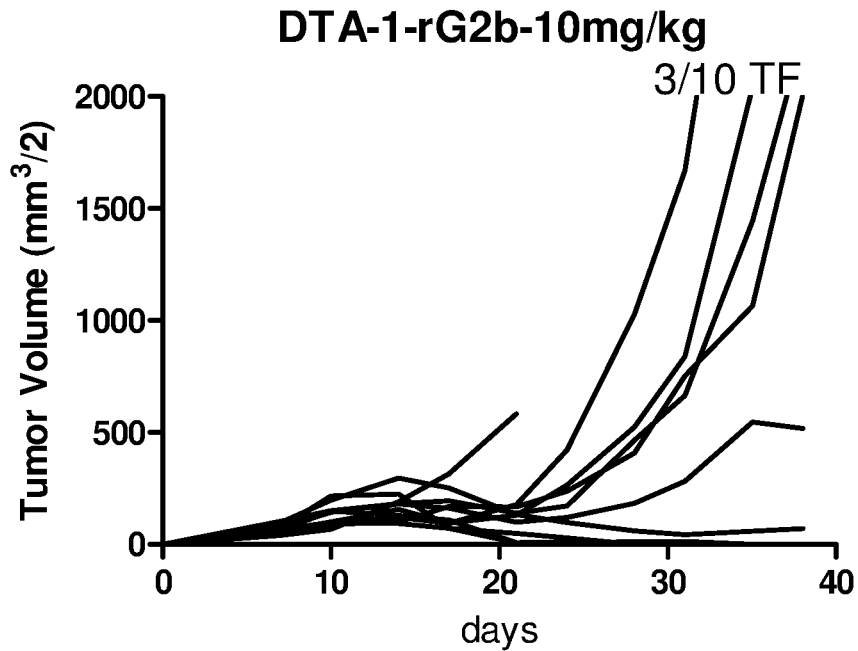
Figure 45C:
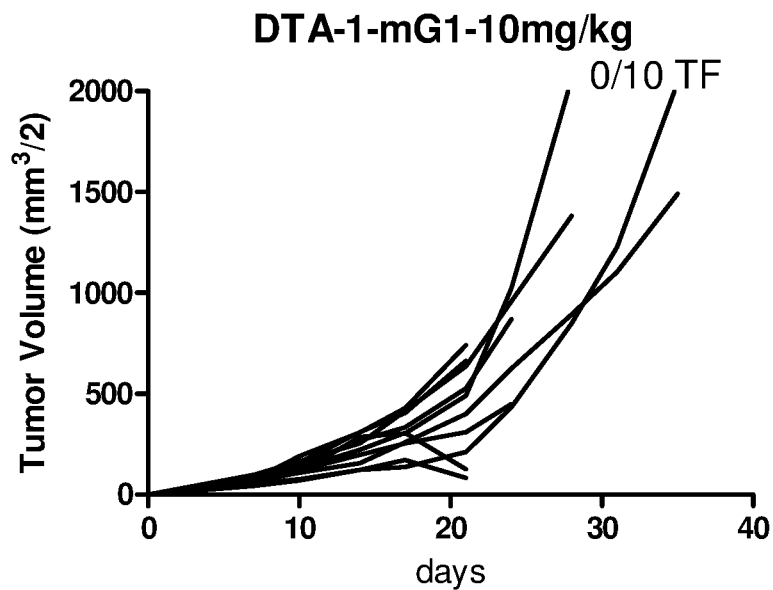
Figure 45D:
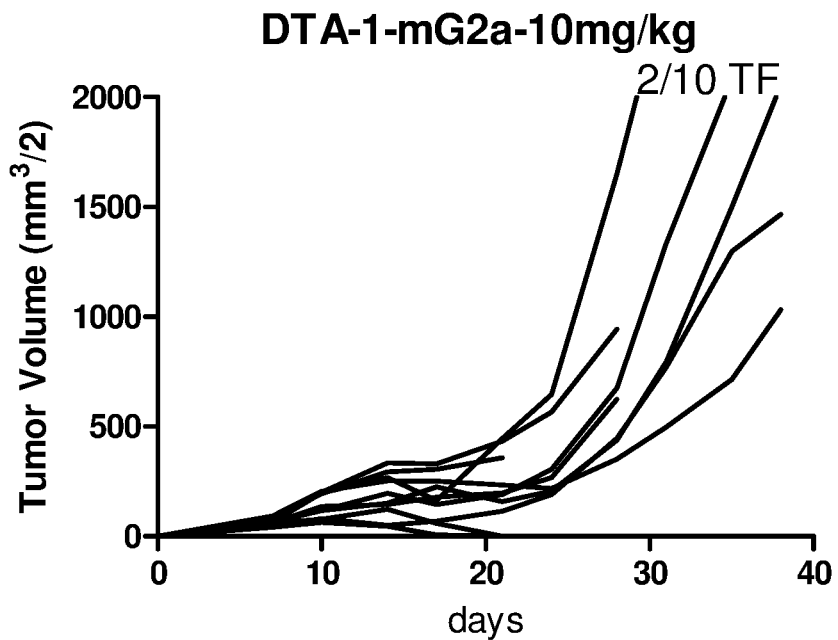

FIG. 45C shows that the IgG1 anti-GITR-treated tumors grew at a comparable rate to that of tumors treated with the mouse IgG1 control (FIG. 45A), none of the 10 mice being tumor free (TF) by the end of monitoring the mice. However, DTA-rG2b (FIG. 45B) and DTA-mG2a (FIG. 45D) significantly reduced the rate of tumor growth, with 3 and 2 out of 10 mice, respectively, being TF.

Figure 46A:
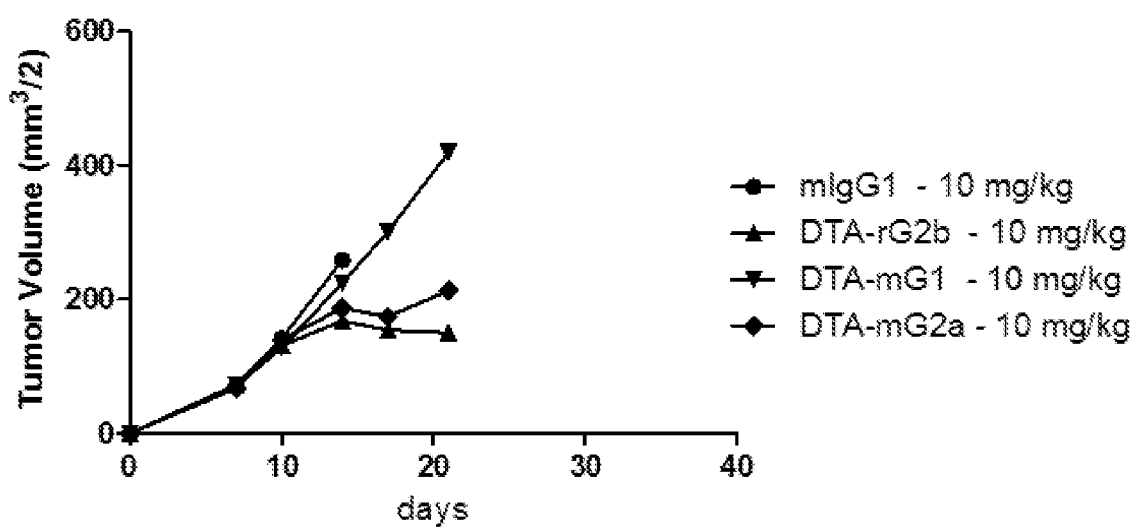
FIGS. 46A and 46B show the changes in mean (FIG. 46A) and median tumor volumes (FIG. 46B) of MC38 tumors in groups of mice treated with DTA-1 antibodies (10 mg/kg) of different isotypes.
Figure 46B:
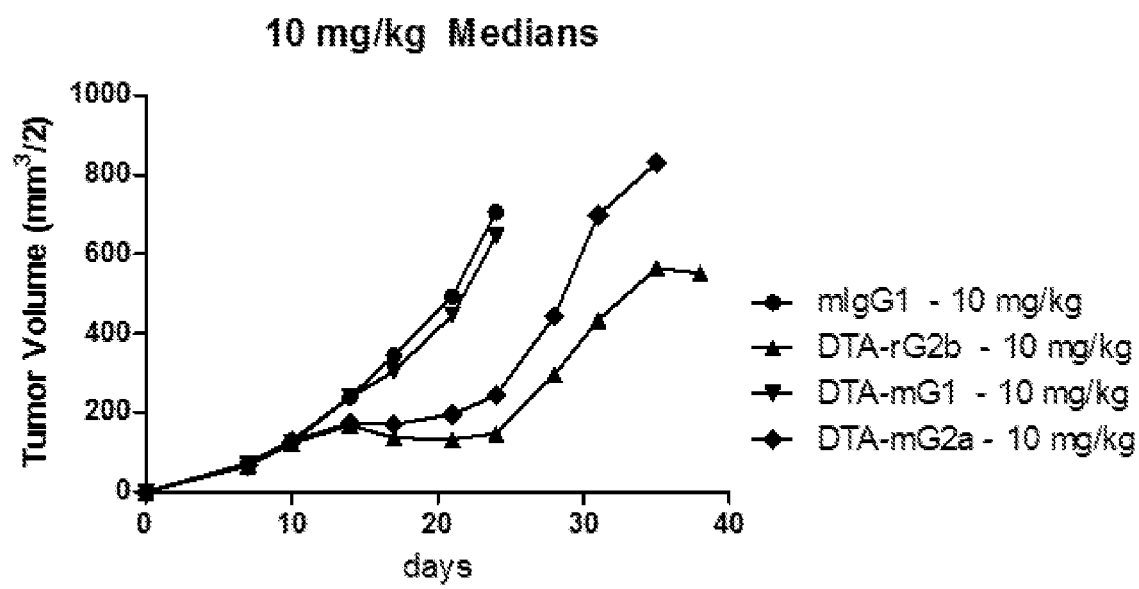

The changes in mean tumor volumes and median tumor volumes of the mice of groups treated with the different anti-GITR isotypes are plotted in FIGS. 46A and 46B. These plots confirm the individual mouse data shown in FIG. 45 that the IgG2b isotype of the anti-GITR antibody exhibits the most potent inhibitory effect on MC38 tumor growth, with the IgG2a isotype only slightly less potent. The IgG1 isotype shows little inhibition of tumor growth, with the mean and median tumor volumes being similar to those in mice treated with the mouse IgG control.

Figure 47A:
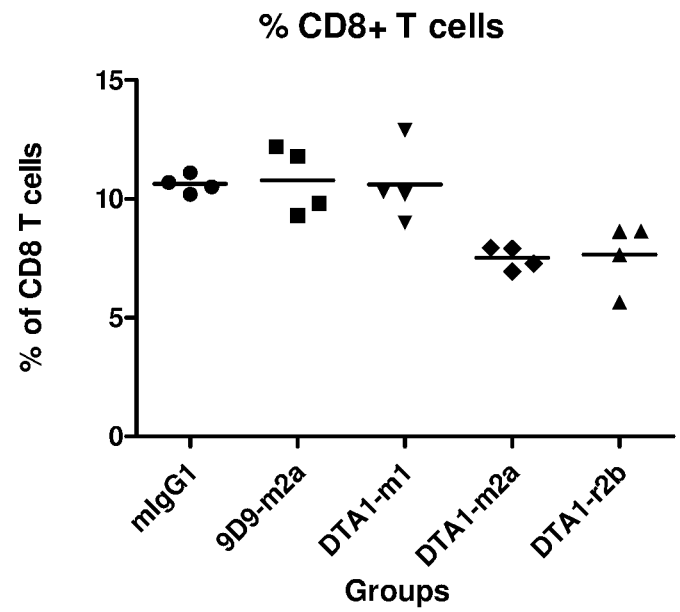
FIGS. 47A-47F show a flow cytometric analysis of spleens (FIGS. 47A-47C) and tumor infiltrating lymphocytes (TILs) (FIGS. 47D-47F) from MC38 tumor-bearing mice treated with the different anti-GITR (DTA-1) and anti-CTLA-4 (9D9) isotypes and control antibody indicated.
Figure 47B:
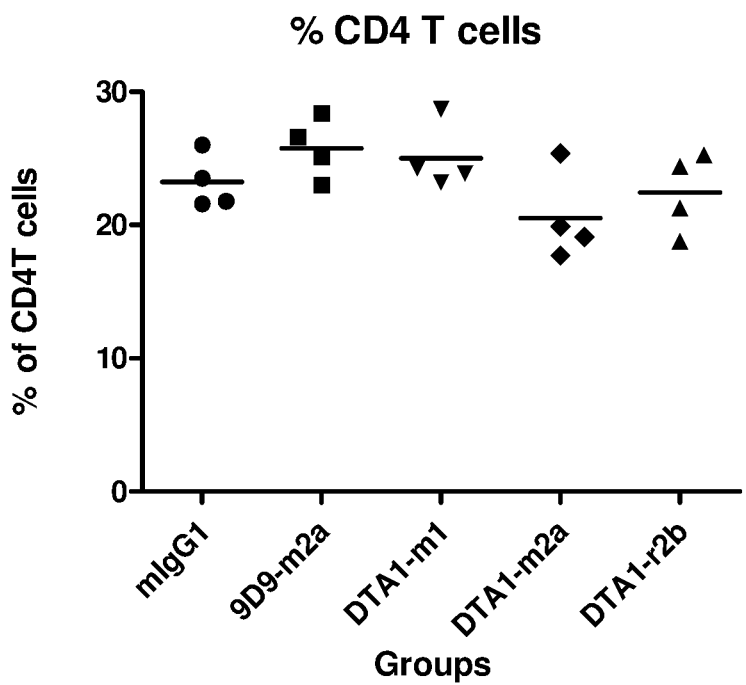
Figure 47C:
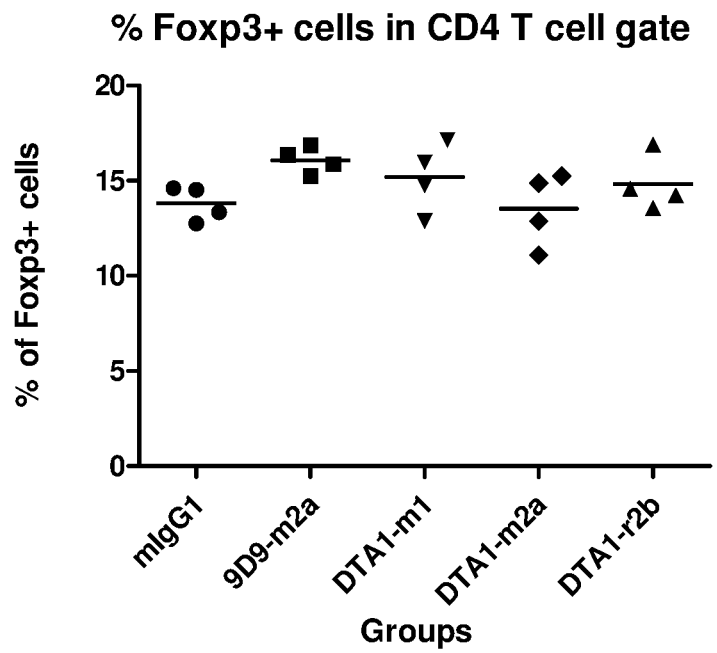

The effects of anti-GITR isotypes on MC38 T cell subsets in TILs and spleen was also determined. The populations of T cell subsets in MC38 TILs and spleens from mice treated with the different anti-GITR isotypes were compared. In the spleen, DTA-m2a and DTA-r2b caused a slight reduction in the level of CD8⁺ cells whereas 9D9-m2a (an anti-CTLA-4 antibody) and DTA-ml did not alter CD8⁺ T cell levels (FIG. 47A). None of the isotype variants tested had a significant effect on the percentage of CD4⁺ or CD4⁺Foxp3⁺ cells in the spleen (FIGS. 47B and 47C).

Figure 47D:
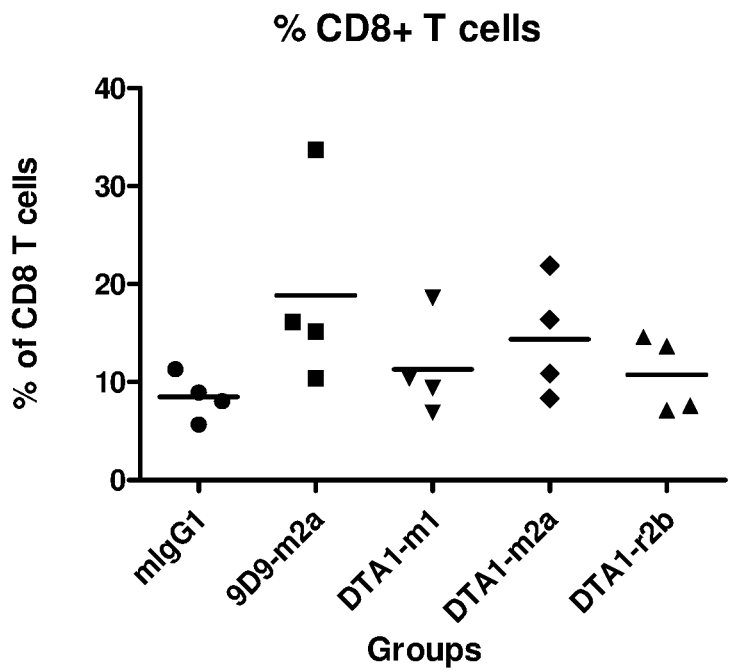
Figure 47E:
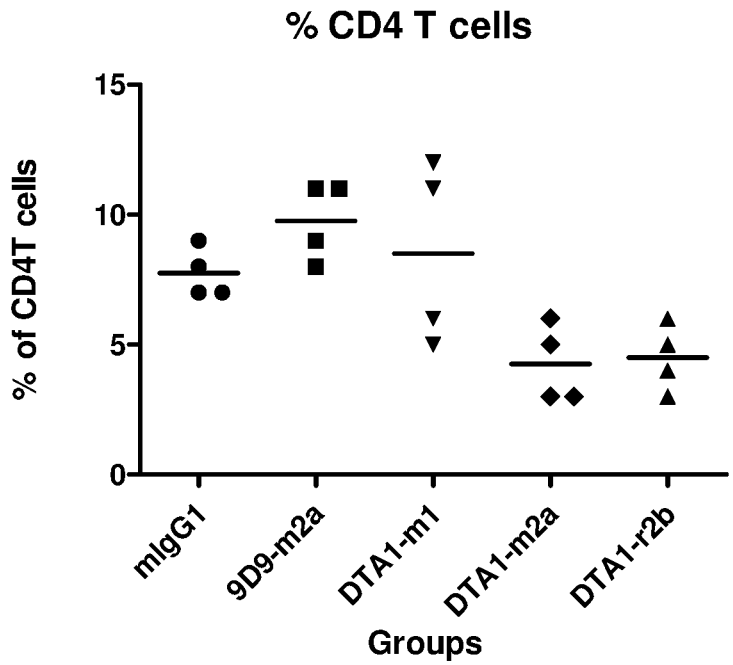

In TILs, 9D9-m2a caused at least a 2-fold increase in the percentage of CD8⁺ cells compared to both the mouse IgG1 control (FIG. 47D). DTA-m2a had a less pronounced effect, increasing the percentage of CD8⁺ cells about 50%, whereas DTA-ml and DTA-r2b caused no, or only a marginal increase in, the percentage of CD8⁺ cells compared to the mouse IgG1 isotype control (FIG. 47D). 9D9-m2a caused a small increase in the percentage of CD4⁺ cells compared to the mouse IgG1 isotype control, whereas DTA-ml caused no change in CD4⁺ (FIG. 47E). In contrast, both DTA-m2a and DTA-r2b reduced CD4⁺ percentages by 40-50% compared to both the mouse IgG1 isotype (FIG. 47E).

Figure 47F:
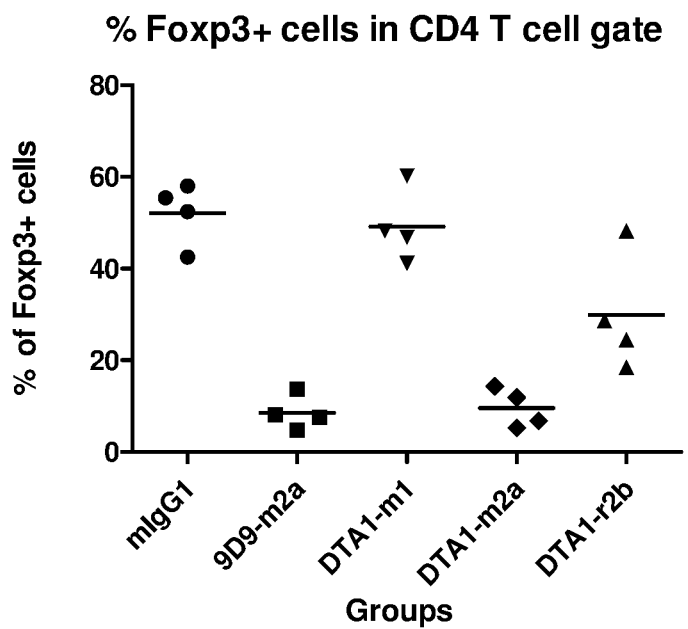

The most dramatic effects were seen with the levels of CD4⁺Foxp3⁺ $T_{regs}$ among the TILs. While DTA-ml had no effect on this population of T cells, 9D9-m2a and DTA-m2a induced an approximately 6-fold reduction in the level of CD4⁺Foxp3⁺ $T_{regs}$ compared to the IgG1 isotype and DTA-ml (FIG. 47F). These data demonstrate that the IgG2a variant of anti-GITR reduces the level of $T_{regs}$ specifically in the tumor environment. Thus, the IgG2a anti-GITR isotype induces an increase in CD8⁺ $T_{effs}$ and decrease in $T_{regs}$ at the tumor site which translates into an elevated $T_{eff}$ to $T_{reg}$ ratio that is indicative of robust anti-tumor activity. DTA-r2b also induced significant reduction in the level of CD4⁺Foxp3⁺ $T_{regs}$ compared to the IgG1 control, though not as pronounced a reduction as that induced by 9D9-m2a and DTA-m2a, consistent with the lower binding of the rat IgG2b Fc region to murine activating FcγRs. These data demonstrate that the agonist anti-GITR antibody requires engagement of activating FcγRs for depletion activity.

Flow cytometric measurement of the level of GITR expression on different subsets of T cells in MC38 TILs and spleen showed that GITR was most highly expressed on $T_{regs}$ at the tumor site, that level of expression being higher than on $T_{regs}$ in the periphery or CD8$^+$ $T_{effs}$ at the tumor site, which in turn exhibited higher expression than CD8$^+$ or CD4$^+$ $T_{effs}$ in the periphery. The lowest relative level of GITR expression was seen on CD4$^+$ $T_{effs}$ at the tumor site. These data suggest a mechanism whereby T cell depletion activity assists in stimulating a T cell response and thereby enhance anti-tumor efficacy of a Fc fusion protein if the target of the Fc fusion protein is highly expressed on $T_{regs}$ at the tumor site relative to expression of the target on $T_{effs}$ at the tumor site, and the Fc fusion protein binds to an activating FcR that mediates depletion of the target cell.

b) Experiment MC38 #2

Because of the aggregation encountered with the DTA-1 variants (except the commercially obtained original form of DTA-r2b), a new set of isotypic variants were reengineered to obtain DTA-1 antibodies that do not aggregate. The aggregation observed was traced to an extra amino acid that had inadvertently been incorporated into the light chain of the engineered isotypic variants, and the problem was alleviated by removal of this extraneous amino acid. The reengineered antibodies were used in this Experiment #2. The anti-tumor activity of the reengineered anti-GITR (DTA-1; GITR.7 series) isotypes was assessed using a staged MC38 model. C57BL/6 mice were each subcutaneously implanted with 2×10$^6$ MC38 cells. After 7 days, the mice were randomized into 7 treatment groups so as to have comparable mean tumor volumes of about 148 mm$^3$/2), and test antibodies were administered IP on Days 7, 10 and 14 at 200m per dose (except for the mIgG control which was administered at a dose of 200 μg) as follows: Group 1: mouse IgG1 control (mIgG or "isotype"); Group 2: anti-GITR mouse IgG1Ab (mGITR.7.mg1); Group 3: anti-GITR mouse IgG1D265A isotype (mGITR.7.mg1-D265A); Group 4: anti-GITR mouse IgG2a Ab (mGITR.7.mg2a); Group 5: anti-GITR mouse IgG2b Ab (mGITR.7.mg2b); and Group 6: anti-GITR rat IgG2b Ab (mGITR.7.r2b or DTA-1-rG2b). Tumors and spleens were harvested on Day 15.

Figure 48A:
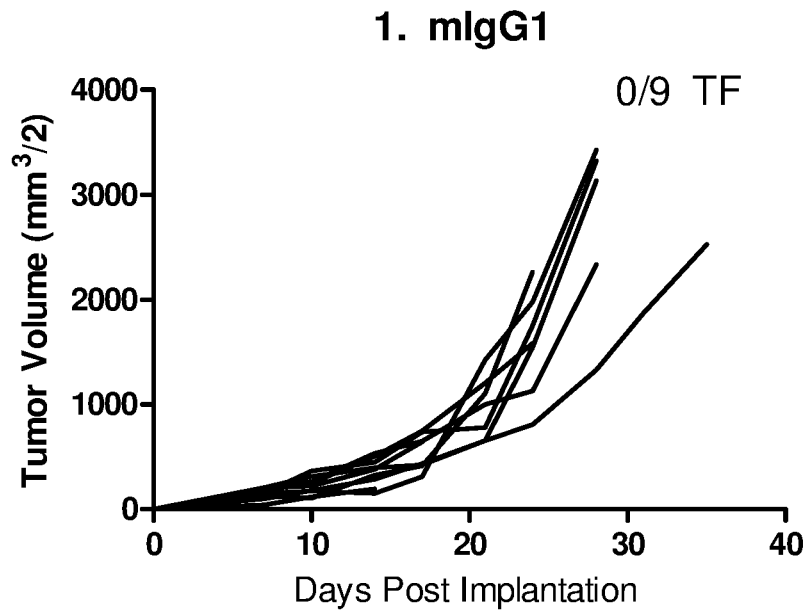
FIGS. 48A-48F show the effects of different isotypes of the rat anti-mouse GITR antibody, DTA-1, re-engineered to minimize aggregation (referred to as "mGITR.7"), on anti-tumor activity as measured by changes in the tumor volumes in individual mice treated with these isotypes in a MC38 model.
Figure 48B:
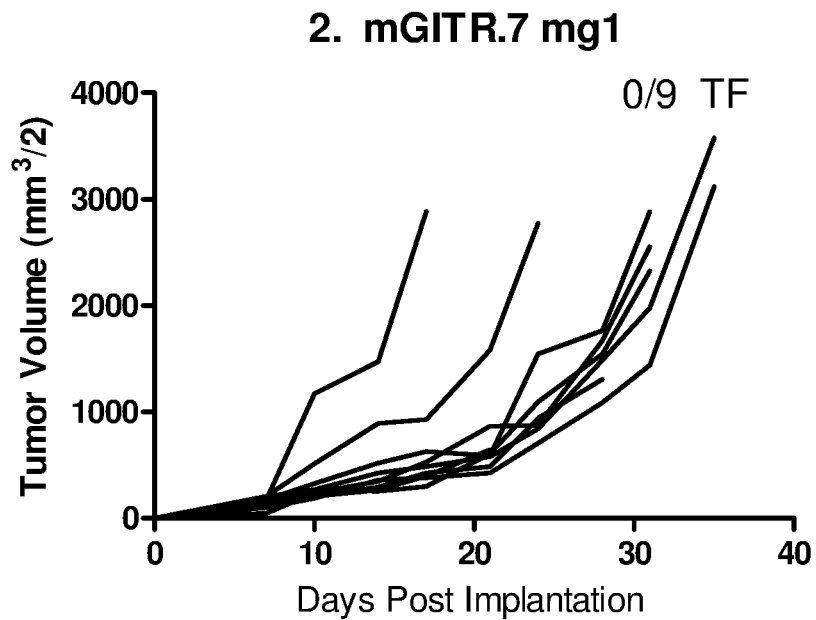
Figure 48C:
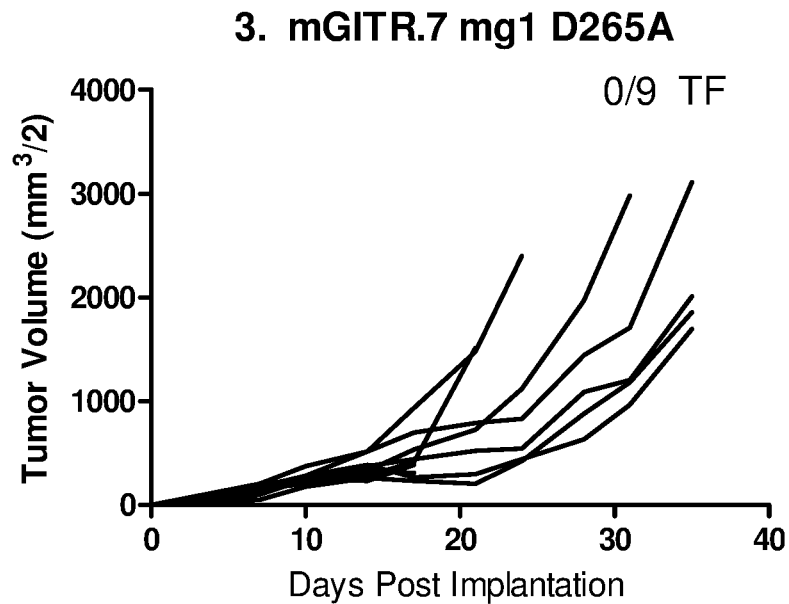
Figure 48D:
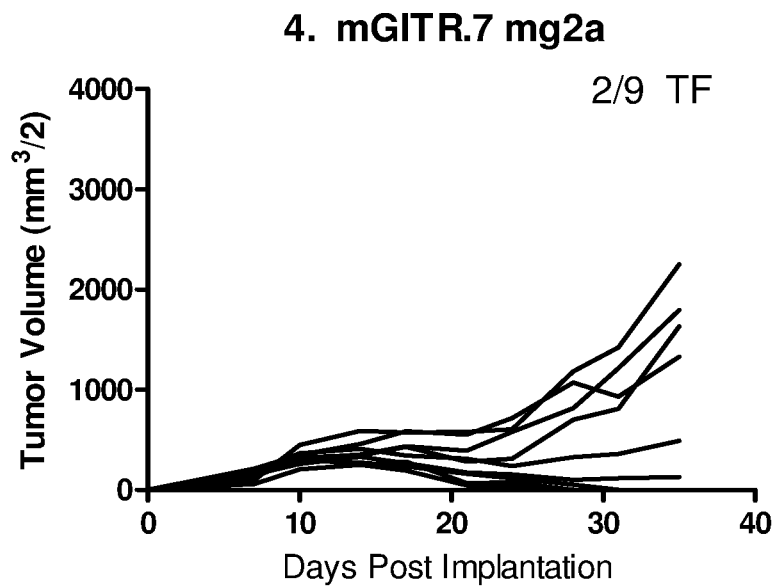
Figure 48E:
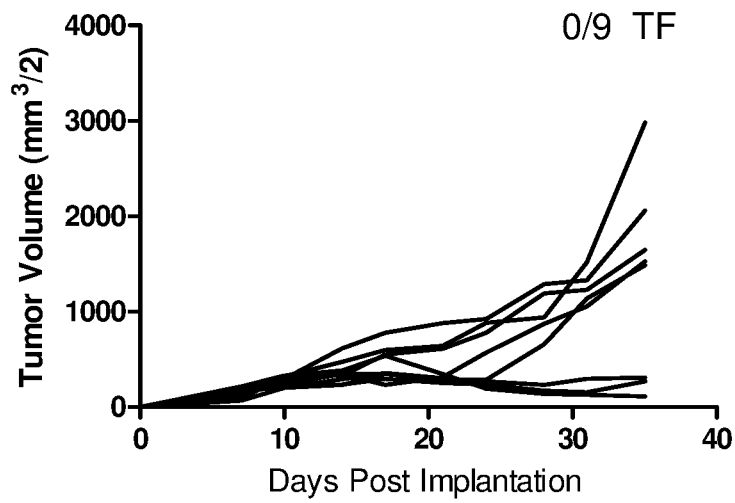
Figure 48F:
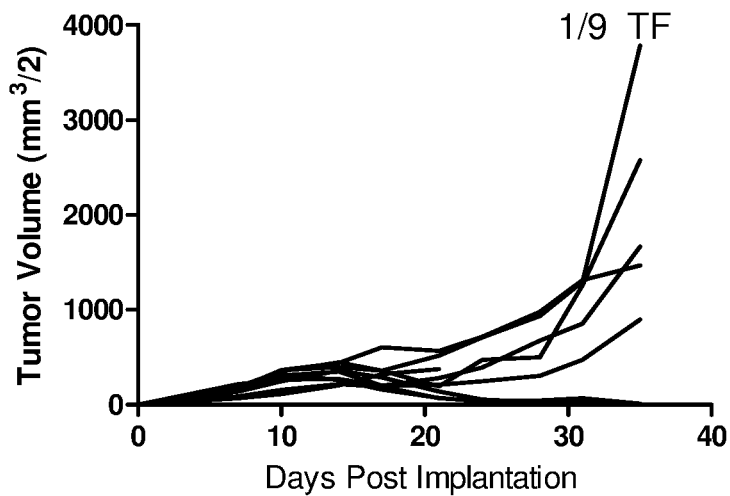

FIGS. 48B and 48C show that the IgG1 and IgG1-D265A anti-GITR-treated tumors grew at a comparable rate to that of tumors treated with the mouse IgG1 control (FIG. 48A). In each case, none of the 9 mice being TF by the end of monitoring the mice 35 days post-implantation. However, similar to the results in Experiment MC38 #1, mGITR.7.mg2a (FIG. 48D) induced the greatest inhibition of tumor growth, with 2 out of the 9 mice being TF. The mouse and rat anti-GITR-2b antibodies also significantly reduced the rate of tumor growth to similar extents (FIGS. 48E and 48F), though the rat 2b antibody produced 1 TF mouse while the mouse 2b antibody did not produce any TF mice 35 days post-implantation.

Figure 49A:
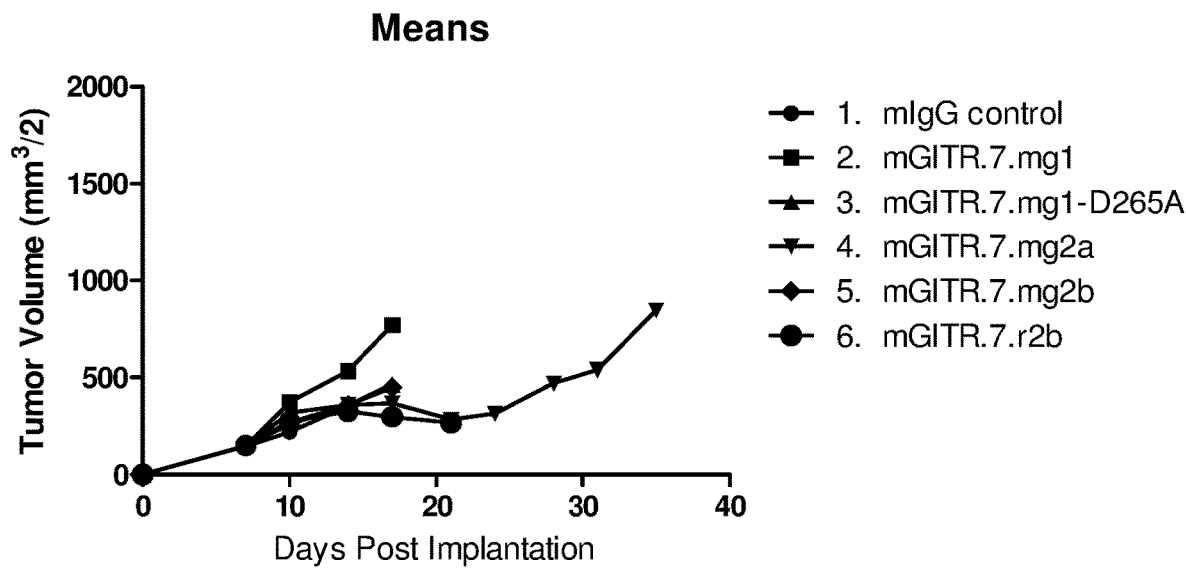
FIGS. 49A and 49B show the changes in mean (FIG. 49A) and median tumor volumes (FIG. 49B) of MC38 tumors in groups of mice treated with re-engineered DTA-1 antibodies of different isotypes.
Figure 49B:
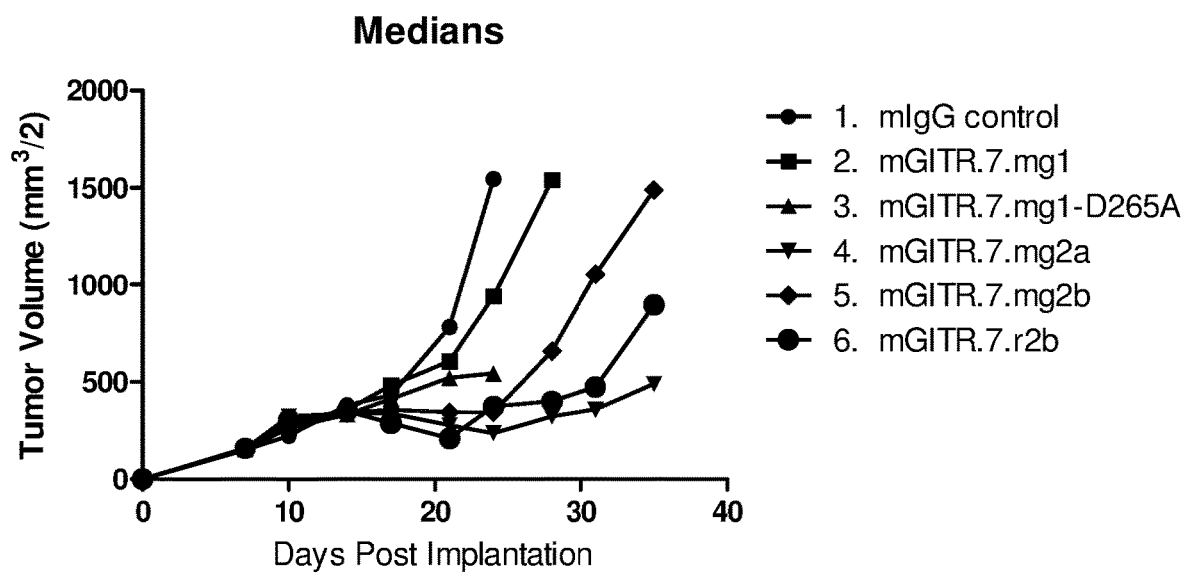

Changes in mean tumor volumes and median tumor volumes are shown in FIGS. 49A and 49B. The trends are similar to those seen in MC38 Experiment 1 except that the IgG2a anti-GITR isotype was the most potent inhibitor of MC38 tumor growth, while the IgG2b isotype exhibits significant, but lower, potency in inhibiting tumor growth. The IgG1 and IgG1-D265A isotypes showed a low-level inhibition of tumor growth compared to the mouse IgG control.

Figure 50A:
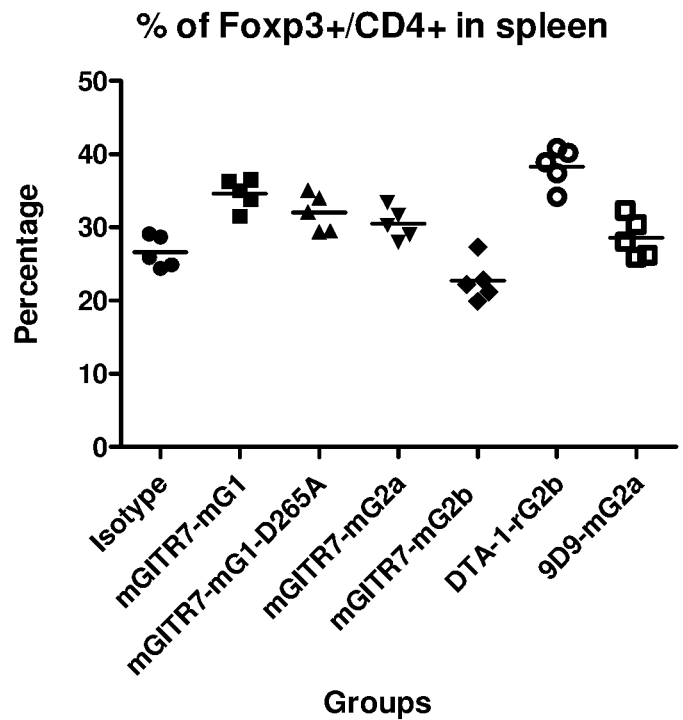
FIGS. 50A and 50B show a flow cytometric analysis of the effects of different DTA-1 (reengineered "mGITR" DTA-1 or the originally engineered "DTA-1" antibodies) and anti-CTLA-4 (9D9) isotypes on Foxp3$^+$/CD4$^+$ T$_{regs}$ in spleens (FIG. 50A) and TILs (FIG. 50B) from MC38 tumor-bearing mice.

The effects of the different anti-GITR isotypes on the populations of $T_{regs}$ in TILs and spleens from the treated mice are shown in FIG. 50. As observed in Experiment #1, none of the isotype variants tested had a huge effect on the percentage of CD4$^+$Foxp3$^+$ $T_{regs}$ in the spleen: the strongest effect was a less that 40% increase induced by treatment with the rat anti-GITR IgG2b isotype, whereas the mouse anti-GITR IgG2b isotype marginally reduced the percentage of CD4$^+$Foxp3$^+$ $T_{regs}$. The other anti-GITR isotypes tested and the anti-CTLA-4 IgG2a (9D9-mG2a) antibody marginally increased the percentage of $T_{regs}$ (FIG. 50A).

Figure 50B:
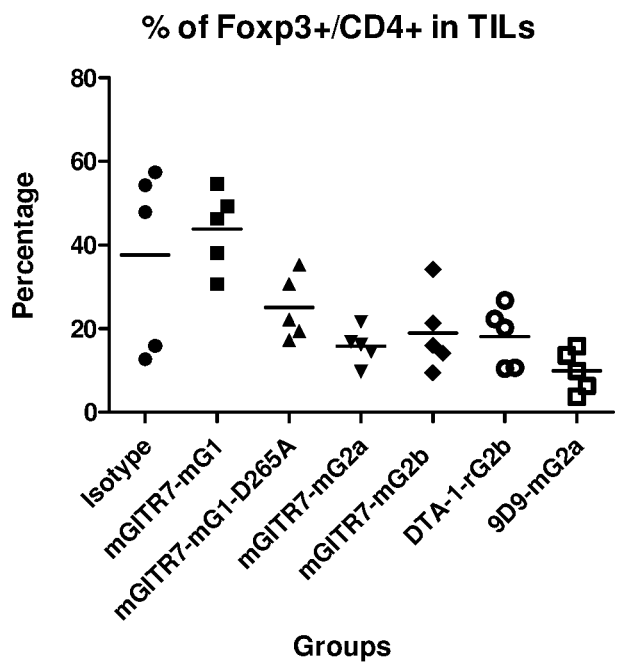
Figure 51A:
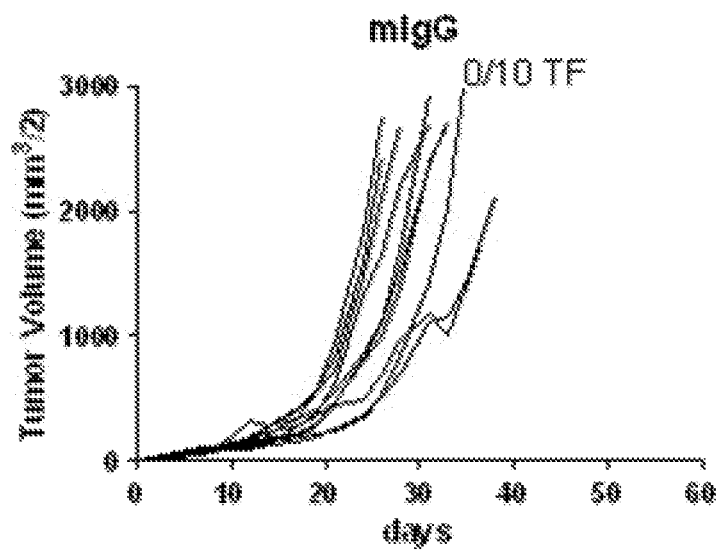
FIGS. 51A-51E show the anti-tumor activity of different mouse DTA-1 isotypes in a Sa1N fibrosarcoma mouse model as measured by the changes in tumor volumes of individual mice treated with these isotypes.
Figure 51B:
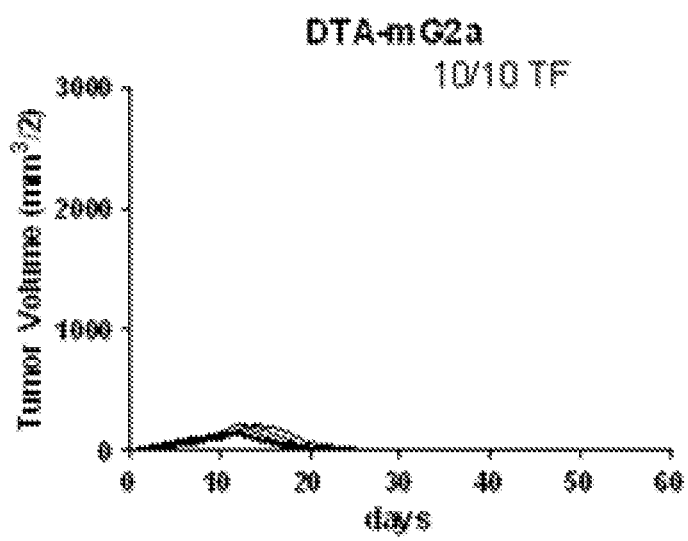
Figure 51C:
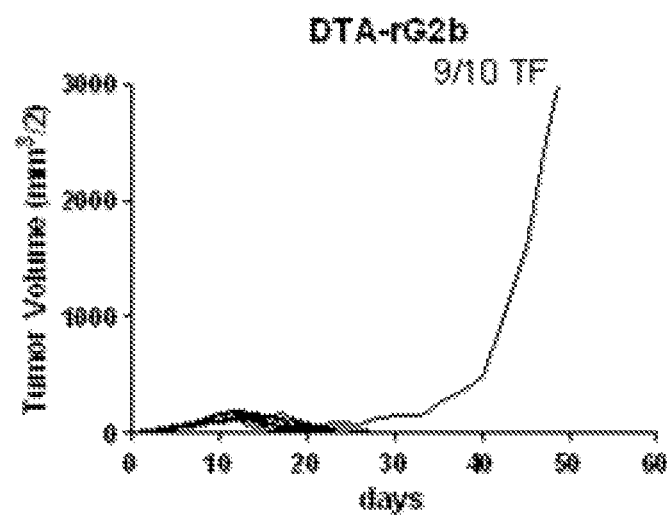
Figure 51D:
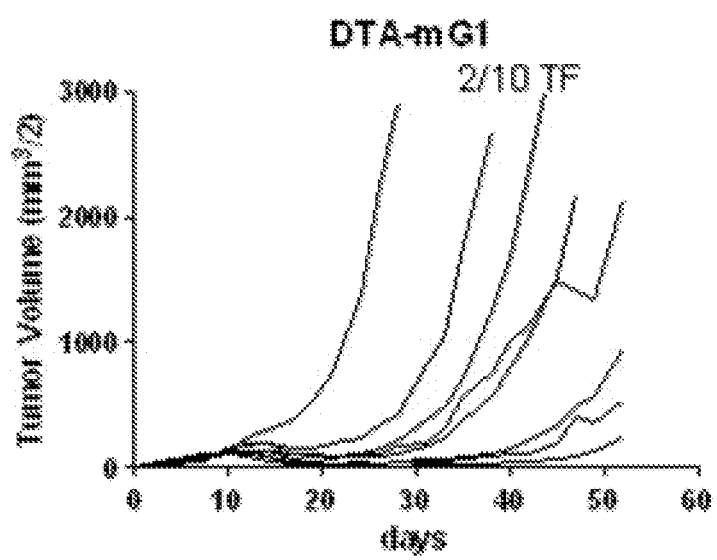
Figure 51E:
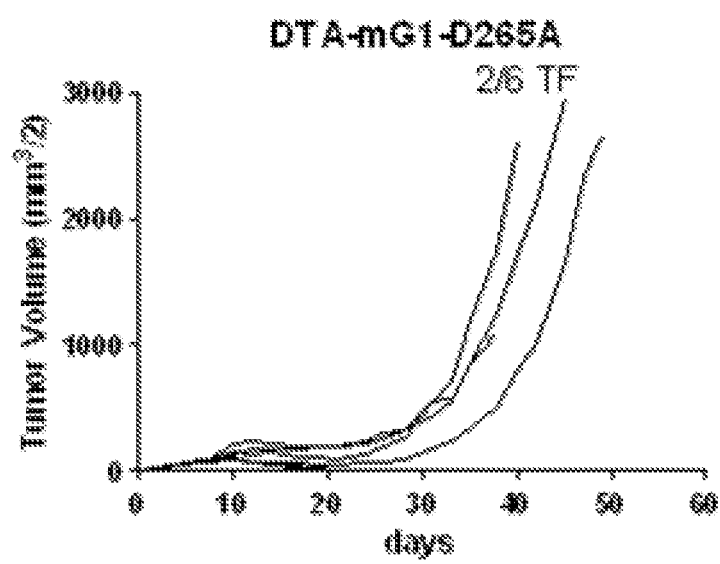

In contrast, in the TILs, with the exception of the IgG1 isotype, which caused no change compared to the isotype control, all of the antibodies tested induced significant reductions in the percentage of $T_{regs}$. Anti-CTLA-4 antibody 9D9-mG2a cause an approximately 4-fold reduction in the level of CD4$^+$Foxp3$^+$ $T_{regs}$ compared to the IgG1 isotype; the anti-GITR mouse 2a and 2b isotypes and the rat 2b isotype all lowered the level of $T_{regs}$ about 2-fold, and the IgG1-D265A mutant caused a slightly lower reduction (FIG. 50B). These data confirm the effects seen in Experiment #1 in demonstrating that anti-GITR mG2a, mG2b and rG2b isotypes induce significant $T_{reg}$ depletion in the tumor environment, which correlates with tumor growth inhibition.

The data obtained in Experiment MC38 #2 are largely consistent with those obtained in Experiment #1, which suggests that aggregation of the antibodies did not unduly interfere with the activities of the antibodies. Possibly, the aggregated antibodies are rapidly flushed in the mice and, thus, antibody aggregation may not be a significant problem in the present in vivo assays.

Example 17: Anti-Tumor Activity of Variant Anti-GITR Isotypes in a Staged Sa1N Tumor Model The anti-tumor activity of anti-GITR was also assessed in a Sa1N sarcoma model in A/J mice. The mice were subcutaneously injected with 2×10$^6$ Sa1N cells per implant. After 7 days, tumor volumes were determined and mice were randomized into treatment groups so as to have comparable mean tumor volumes (about 75 mm$^3$/2). Anti-GITR (DTA-1) antibodies engineered to have different isotypes as described in Example 10, Experiment MC38 #1, were administered IP on Days 7, 10 and 12 at 200 μg per dose.

Figure 52A:
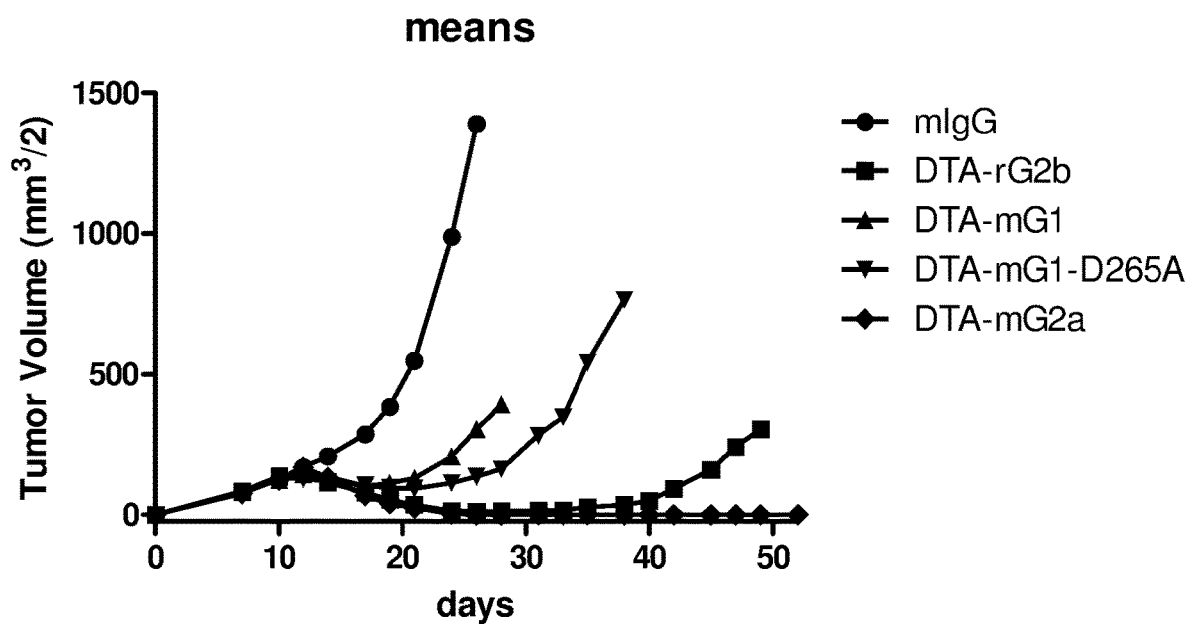
FIGS. 52A and 52B shows the changes in mean (FIG. 52A) and median tumor volumes (FIG. 52B) of Sa1N tumors in groups of mice treated with DTA-1 antibodies of different isotypes.
Figure 52B:
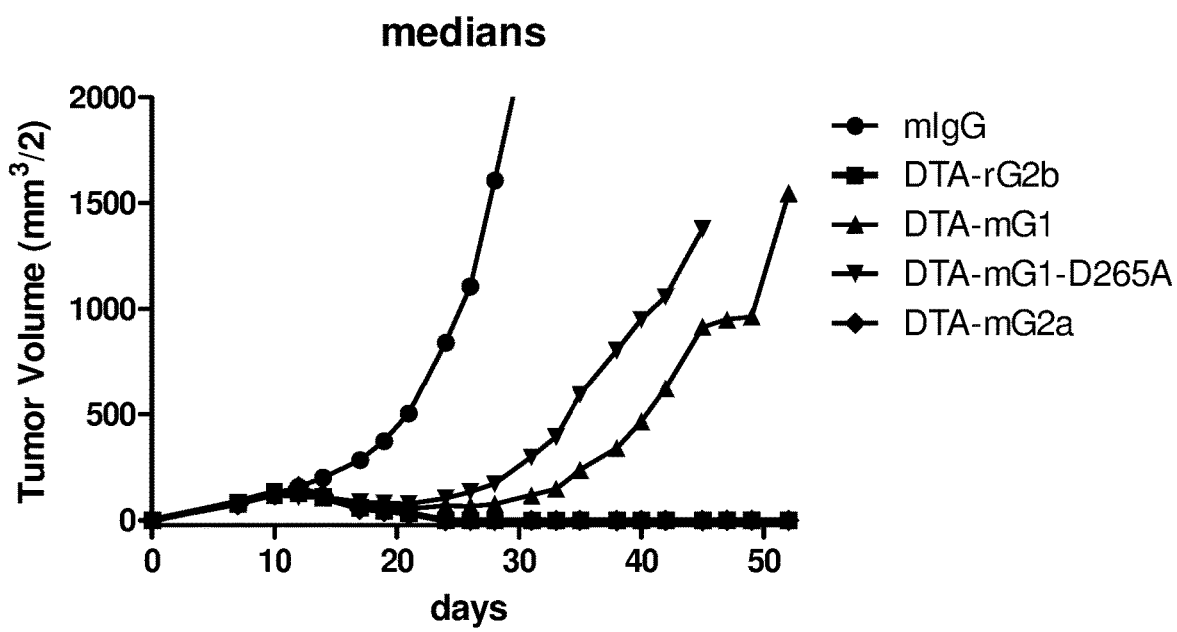

The effects on tumor growth are shown in FIG. 51. Treatment with the IgG2a anti-GITR antibody completely inhibited tumor growth and all 10 mice were TF by about Day 20 post-implantation (FIG. 51B), and the rat IgG2b isotype had a similar effect with 9 out of 10 mice TF by about Day 20 (FIG. 51C). The IgG1 (FIG. 51D) and IgG1D265A (FIG. 51E) isotypes inhibited tumors to some extent compared to the uninhibited growth of IgG1 isotype control-treated tumors (FIG. 51A) but this was much less than the inhibition seen with the mIgG2a and rIgG2b isotypes. The changes in mean tumor volumes and median tumor volumes, shown in FIGS. 52A and 52B, confirm the virtually complete inhibitory effect of the mIgG2a and rIgG2b antibodies on tumor growth, compared to much lower inhibition of tumor growth exhibited by the mIgG1 and mIgG1-D265A isotypes.

Collectively, the data in FIGS. 51 and 52 confirm the data obtained with the MC38 tumor model (Example 10) showing that the anti-GITR mIgG2a and rIgG2b isotypes exhibit potent anti-tumor activity in contrast to the mIgG1 (and mIgG1-D265A) isotypes which exhibit much lower anti-tumor activity. Antitumor activity in the Sa1N model of the mIgG1 and the D265A variant antibodies is consistent with effects of agonism of GITR without Treg depletion.

Figure 53A:
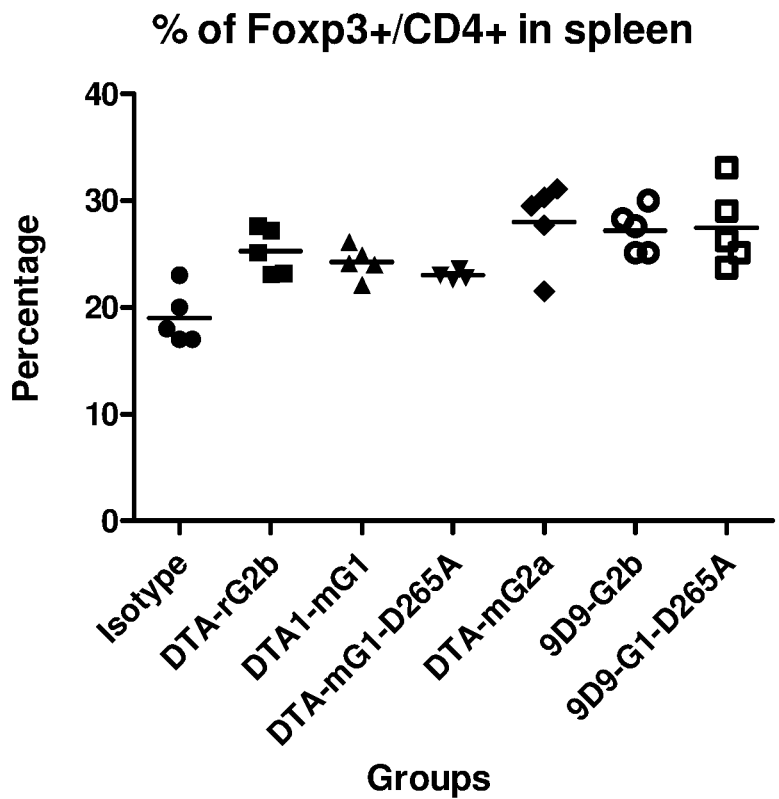
FIGS. 53A and 53B show the effects of different DTA-1 and anti-CTLA-4 (9D9) isotypes on Foxp3$^+$/CD4$^+$ T$_{regs}$ in spleens (FIG. 53A) and TILs (FIG. 53B) from Sa1N tumor-bearing mice.

The effects of the different anti-GITR isotypes on the populations of $T_{regs}$ in Sa1N TILs and spleens from the treated mice are shown in FIG. 53. All of the anti-GITR isotype variants tested induced relatively small increases of about 20-40% in the level of CD4+Foxp3+ $T_{regs}$ in the spleen. The highest increase was induced by treatment with the mouse anti-GITR IgG2a isotype, which caused the same increase as treatment with the anti-CTLA-4 IgG2b (9D9-G2b) and IgG1-D265A (9D9-G1-D265A) antibodies (FIG. 53A). The latter anti-CTLA-4 isotypes were used as positive controls in this GITR study as $T_{reg}$ depletion had previously been observed with IgG2b isotype.

Figure 53B:
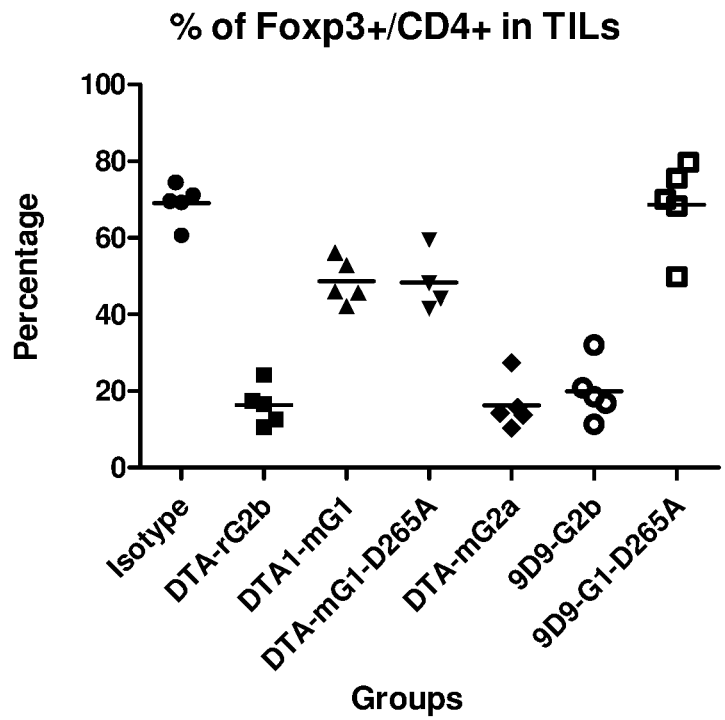
Figure 54A:
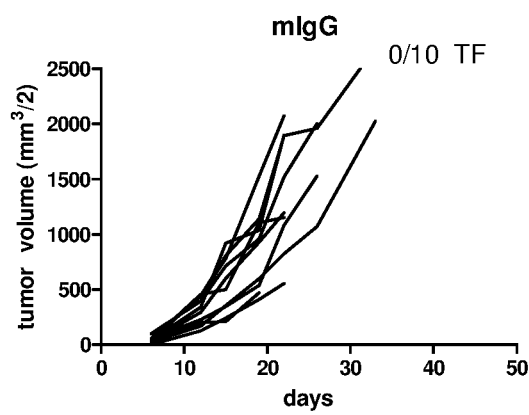
FIGS. 54A-54D show the effects of the rat anti-GITR antibody, DTA-1, on tumor volume using a staged MC38 colon adenocarcinoma model. Mice were treated with (FIG. 54A) control mIgG1, (FIG. 54B) mIgG+DTA-1, (FIG. 54C) mIgG+PD-1, and (FIG. 54D) PD-1+DTA-1 on days 7, 10, and 14. The number of tumor free (TF) mice per group is shown for each group of 10 mice.
Figure 54B:
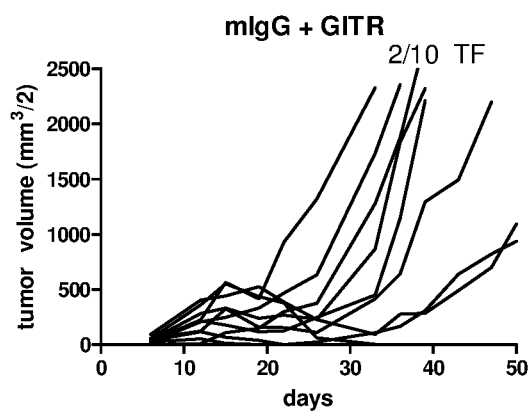
Figure 54C:
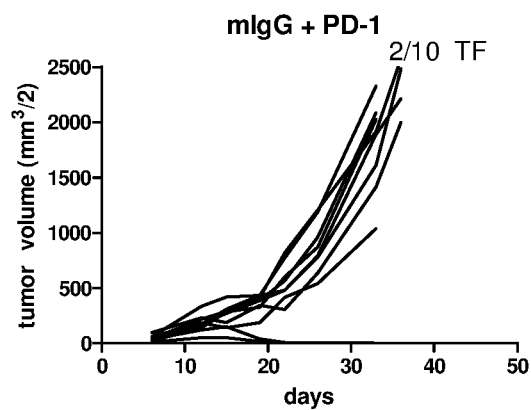
Figure 54D:
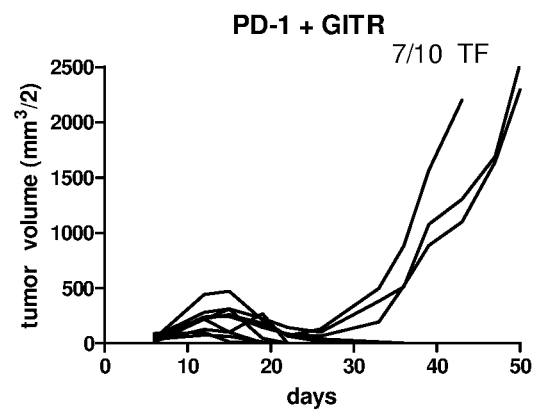

In contrast to the effect of $T_{regs}$ in the periphery, the anti-GITR m2a and r2b isotypes, as well as the anti-CTLA-4 2b isotypes, all lowered the level of $T_{regs}$ at the tumor site by at least 3.5-fold (FIG. 53B). The anti-GITR IgG1 isotype and the IgG1-D265A mutant both induced smaller reductions of about 35% in the percentage of $T_{regs}$, whereas the anti-CTLA-4 IgG1-D265A mutant caused no change in the percentage of $T_{regs}$ in TILs (FIG. 53B). Thus, as observed in the MC38 tumor model, the anti-GITR mG2a and rG2b isotypes induces significant $T_{reg}$ depletion in the tumor environment, much more so than the IgG1 and IgG1-D265A antibodies, which correlates with tumor growth inhibition.

Example 18: Synergistic Activity with Combination of Anti-GITR Antibody and Anti-PD1 Antagonist Antibody To determine whether a synergistic anti-tumor effect could be obtained by combining the DTA-1 antibody with an antibody that antagonizes PD-1, a molecule which provides an inhibitory signal for antitumor mechanisms, the effect of the combination of antibodies on tumor volume using a staged MC38 colon adenocarcinoma model was assessed. Mice were treated with (A) control mIgG1, (B) mIgG+DTA-1, (C) mIgG+PD-1 (clone 4H2, BMS), and (D) PD-1+DTA-1 on days 7, 10, and 14.

The effects on tumor growth are shown in FIG. 54. Treatment with the DTA-1 antibody or anti-PD-1 antibody individually inhibited tumor growth to a certain extent, with 2 out of 10 mice each being TF. In contrast, the combination of DTA-1 antibody and anti-PD-1 antibody substantially increased the number of TF mice by day 30, with 7 out of 10 mice being TF. As expected, there were no TF mice in mice administered control mIgG.

These results suggest that the combination of agonistic anti-GITR antibodies and antagonistic anti-PD-1 antibodies acts synergistically to inhibit tumor growth.

Example 19: Effect of CDR Amino Acid Mutations on Binding Affinity

This Example shows that certain amino acid residues in VH CDR3 of 28F3 can be mutated to another amino acid without significantly affecting its binding affinity.

48 mutants of 28F3 were created by mutating one or more of the following amino acids in VH CDR3: M102, D106 and M111 (numbering according to SEQ ID NO: 13) and the following activities were tested: binding to 3A9-hGITR cells and IL-2 secretion of 3A9-hGITR cells in the presence of plate-bound anti-CD3. The experiments were conducted as described above.

Figure 55A:
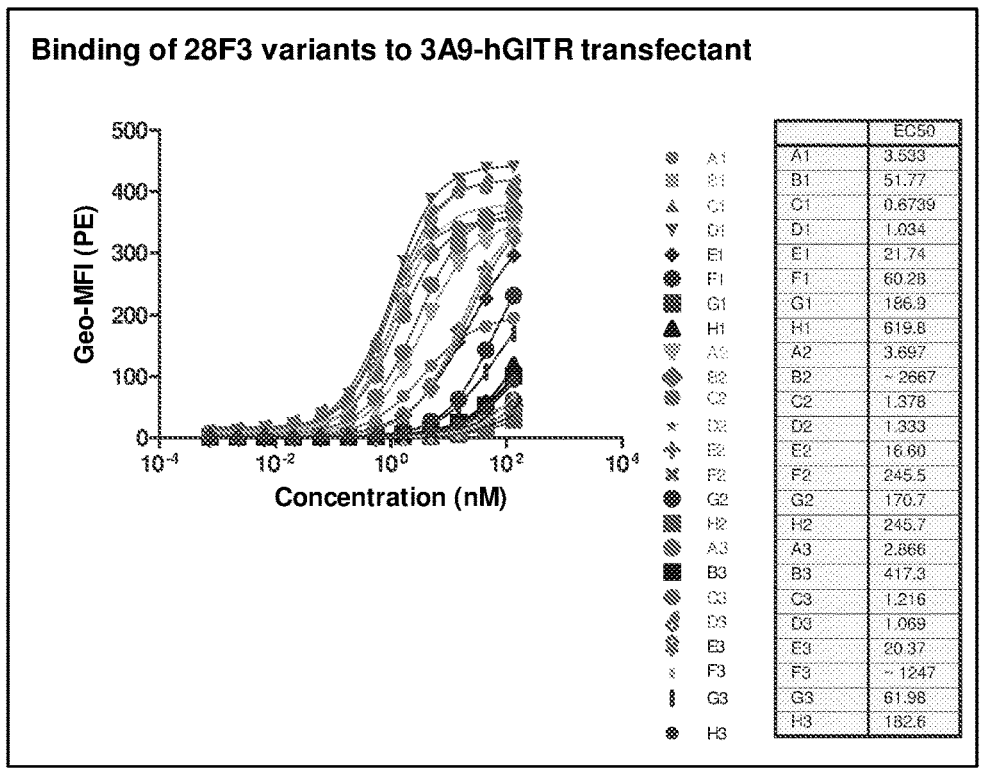
FIGS. 55A and 55B shows the effect of various combinations of mutations in VH CDR3 in anti-GITR antibody 28F3 on binding to 3A9-hGITR cells.
Figure 55B:
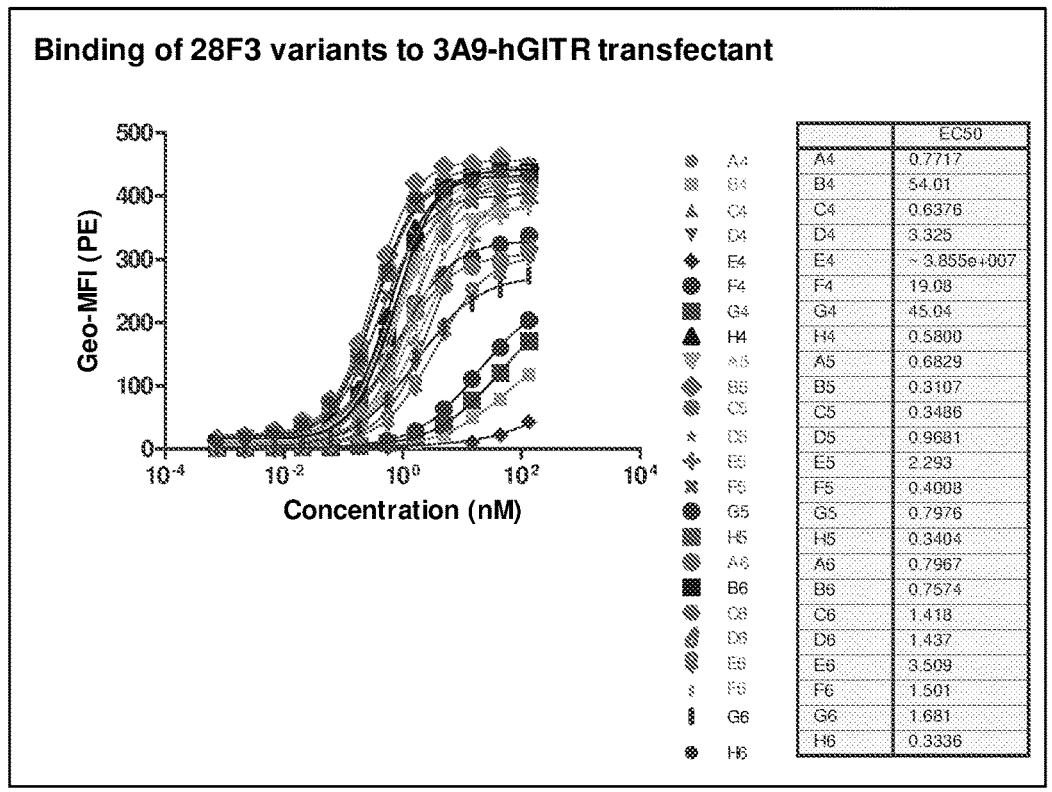
Figure 56A:
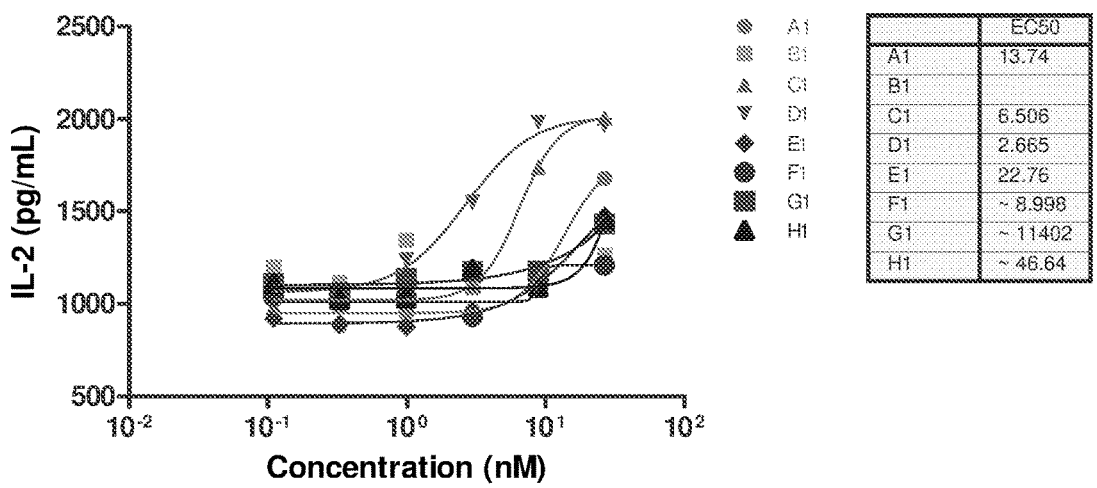
FIG. 56A-56F shows the effect of various combinations of mutations in VH CDR3 in anti-GITR antibody 28F3 on the level of IL-2 secretion from 3A9-hGITR cells in the presence of plate bound anti-CD3.
Figure 56B:
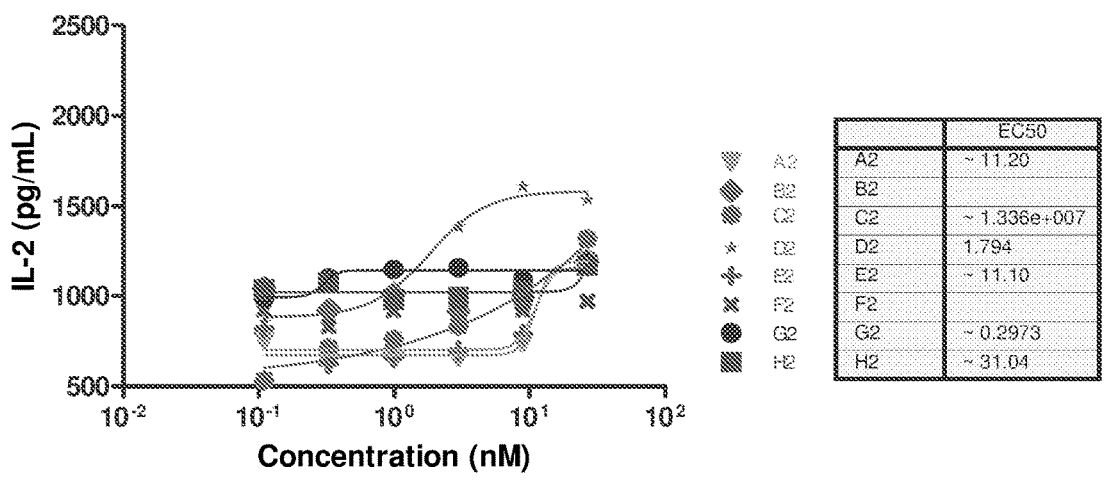
Figure 56C:
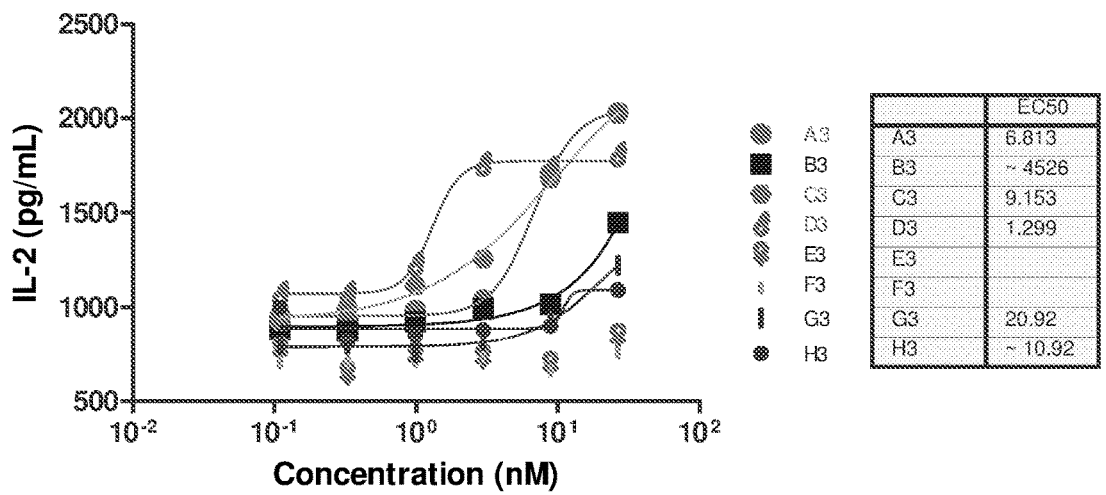
Figure 56D:
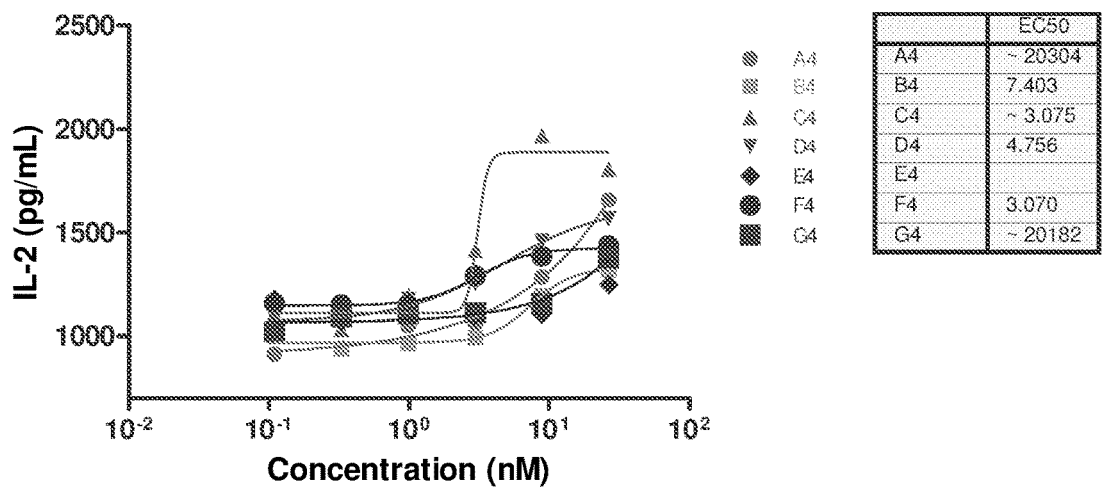
Figure 56E:
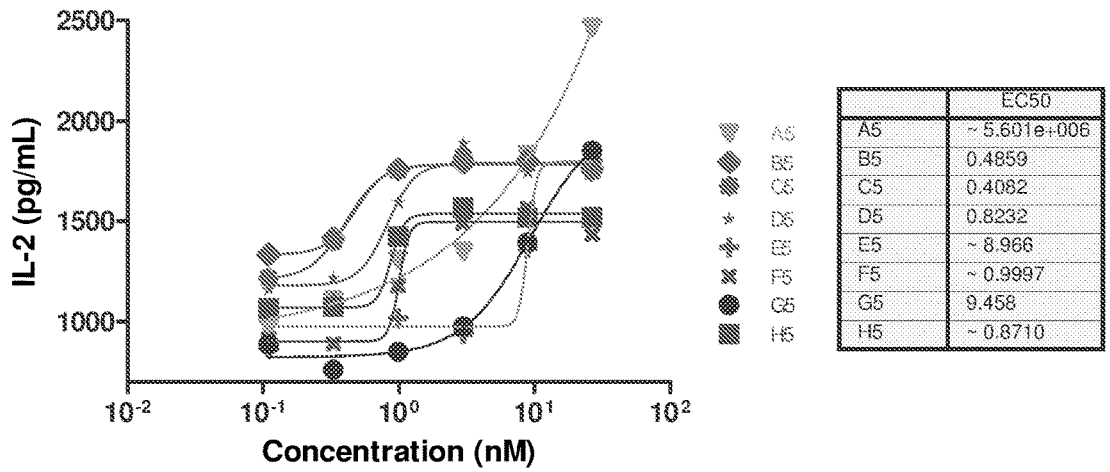
Figure 56F:
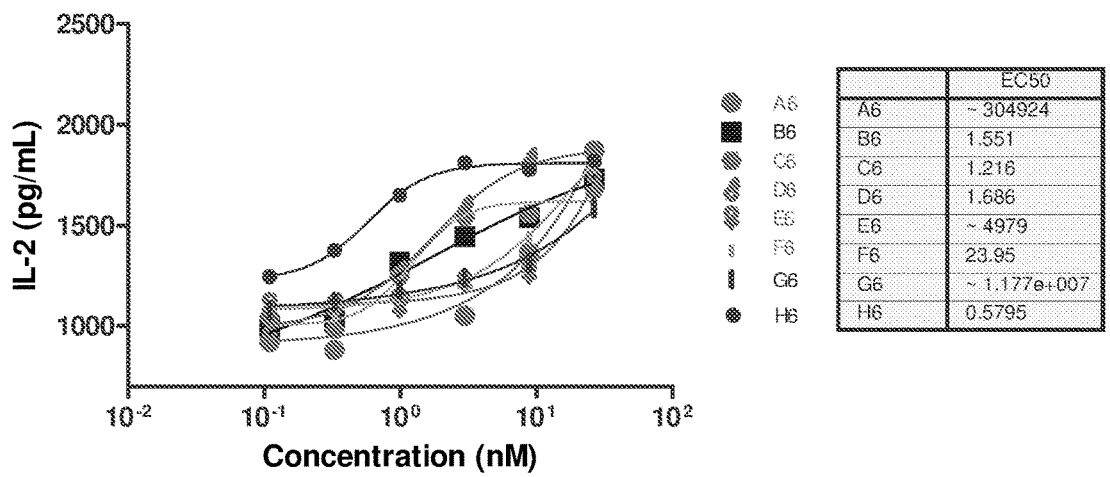

The results, are shown in FIGS. 55A and 55B (binding to 3A9-hGITR cells), FIGS. 56A-F (IL-2 secretion), and Table 7.

TABLE 7

Effects of CDR amino acid mutations on binding affinity

| References in FIGS. 55 and 56 | Mutation(s) | EC50 for antibody activity in 3A9 cells | EC50 for antibody binding by FACS |
|---|---|---|---|
| A1 | M98V, M111L | 1.731 | 0.5297 |
| B1 | M98F, M111L | | 7.762 |
| C1 | M98L, M111L | 0.674 | 0.101 |
| D1 | M98I, M111L | 0.218 | 0.155 |
| E1 | M98Q, M111L | 3.274 | 3.259 |
| F1 | M98S, M111L | | 9.037 |
| G1 | M98A, M111L | | 28.02 |
| H1 | M98Y, M111L | | 92.92 |
| A2 | M98V, M111F | 1.338 | 0.5543 |
| B2 | M98F, M111F | | ~399.9 |
| C2 | M98L, M111F | | 0.2066 |
| D2 | M98I, M111F | 0.1326 | 0.1999 |
| E2 | M98Q, M111F | | 2.489 |
| F2 | M98S, M111F | | 36.81 |
| G2 | M98A, M111F | | 25.59 |
| H2 | M98Y, M111F | | 36.83 |
| A3 | M98V, D106E, M111L | 0.7144 | 0.4297 |
| B3 | M98F, D106E, M111L | | 62.56 |
| C3 | M98L, D106E, M111L | 1.037 | 0.1824 |
| D3 | M98I, D106E, M111L | 0.0883 | 0.1602 |
| E3 | M98Q, D106E, M111L | | 3.054 |
| F3 | M98S, D106E, M111L | | ~187.0 |
| G3 | M98A, D106E, M111L | | 9.292 |
| H3 | M98Y, D106E, M111L | | 27.37 |
| A4 | M98V, D106E, M111F | | 0.1157 |
| B4 | M98F, D106E, M111F | | 8.097 |
| C4 | M98L, D106E, M111F | 0.2618 | 0.09559 |
| D4 | M98Q, D106E, M111F | 0.4539 | 0.4984 |
| E4 | M98S, D106E, M111F | | ~5.77e+006 |
| F4 | M98A, D106E, M111F | 0.2613 | 2.86 |
| G4 | M98Y, D106E, M111F | | 6.752 |
| H4 | M98V, D106E | 0.01499 | 0.08696 |
| A5 | M98F, D106E | | 0.1024 |
| B5 | M98L, D106E | 0.02552 | 0.04658 |
| C5 | M98I, D106E | 0.02048 | 0.05227 |
| D5 | M98Q, D106E | 0.04963 | 0.1451 |
| E5 | M98S, D106E | 1.01 | 0.3437 |
| F5 | M98A, D106E | 0.06304 | 0.06008 |
| G5 | M98Y, D106E | 1.081 | 0.1196 |
| H5 | M98V | 0.05336 | 0.05104 |
| A6 | M98F | | 0.1194 |
| B6 | M98L | 0.1104 | 0.1136 |
| C6 | M98I | 0.1104 | 0.2126 |
| D6 | M98Q | 0.08124 | 0.2155 |
| E6 | M98S | 0.1226 | 0.526 |
| F6 | M98A | 3.491 | 0.225 |
| G6 | M98Y | | 0.252 |
| H6 | Non mutated 28F3 | 0.0418 | 0.05002 |

The results indicate that several mutants have comparable binding and activity to those of 28F3, while other mutations reduce either or both the binding and IL-2 secretion. The following mutants have comparable binding and activity data: M98V; M98V/D106E; M98L/D106E; M98I/D160E; and M98A/D106E.

Example 20: Effects of Constant Region Modifications on GITR Antibody Agonist Activity This Example demonstrates that GITR antibodies comprising an IgG2 hinge have an increased ability to induce IL-2 and IFN-γ secretion from T cells relative to the same antibodies that have an IgG1 hinge.

It had been observed in CHO-OKT3 and 3A9 assays described above that the hybridoma derived antibodies, having an IgG2 constant region, are more potent in stimulating cytokine secretion than the same antibodies in which the heavy chain constant region was switched to that of IgG1 or an effectorless IgG1 (IgG1.1). Therefore, the effect of an IgG2 constant region or hinge was further tested on anti-GITR antibodies in these assays.

The heavy chain variable region of an anti-human GITR antibody was linked to the following heavy chain constant regions:

more potent than the same antibodies having an IgG1 hinge. One potential mechanism to explain the improved effects of the IgG2 hinge containing GITR antibodies is increased internalization and/or increased complex formation of these antibodies at the cell surface, relative to the same antibodies that comprise an IgG1 hinge.

TABLE 8

Constant region configurations of exemplified anti-GITR antibodies

| Name of antibody | CH1 | Hinge | CH2 | CH3 | SEQ ID NO* |
|---|---|---|---|---|---|
| anti-GITR | IgG2 SEQ ID NO: 279 | IgG2 SEQ ID NO: 291 | IgG2 SEQ ID NO: 297 | IgG2 SEQ ID NO: 298 | SEQ ID NO: 221 |
| anti-GITR-IgG2 | IgG2 SEQ ID NO: 279 | IgG2 SEQ ID NO: 291 | IgG2 SEQ ID NO: 297 | IgG2 SEQ ID NO: 298 | SEQ ID NO: 221 |
| anti-GITR-IgG1 | IgG1 SEQ ID NO: 278 | IgG1 SEQ ID NO: 295 | IgG1 SEQ ID NO: 280 | IgG1 SEQ ID NO: 282 | SEQ ID NO: 7 |
| anti-GITR-IgG1.1 | IgG1.1 SEQ ID NO: 278 | IgG1.1 (L234A/L235E/G237A) SEQ ID NO: 296 | IgG1.1 (A330S/P331S) SEQ ID NO: 281 | IgG1.1 SEQ ID NO: 282 | SEQ ID NO: 11 |
| anti-GITR-IgG2-IgG1 or anti-GITR.g2.g1 | IgG2 SEQ ID NO: 279 | IgG2/IgG1 hybrid SEQ ID NO: 293 | IgG1 SEQ ID NO: 280 | IgG1 SEQ ID NO: 282 | SEQ ID NO: 223 |
| anti-GITR-IgG2-IgG1.1 or anti-GITR.g2.g1.1 | IgG2 SEQ ID NO: 279 | IgG2 SEQ ID NO: 291 | IgG1.1 (A330S/P331S) SEQ ID NO: 281 | IgG1 SEQ ID NO: 282 | SEQ ID NO: 224 |

Figure 57:
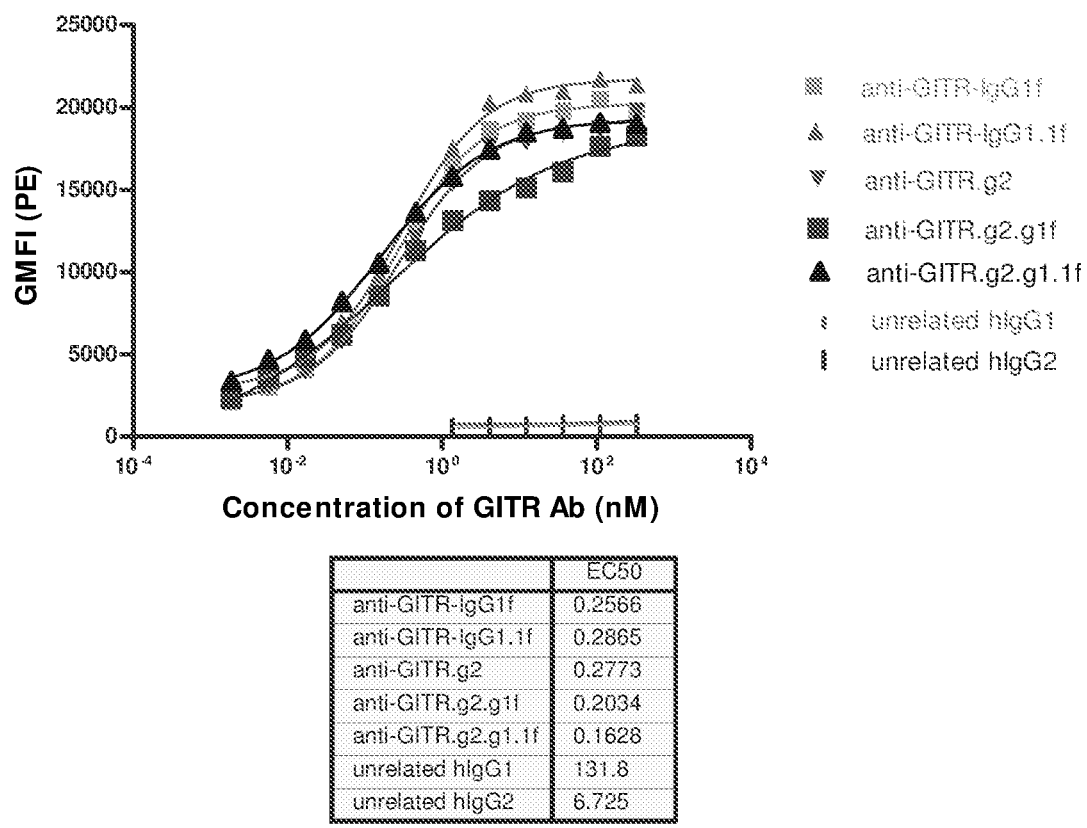
FIG. 57 shows the binding affinity of the indicated anti-GITR antibodies for activated T cells. The antibodies tested comprised one of the following heavy chain constant region: an IgG1 constant region ("anti-GITR.g1f"), an effectorless IgG1 constant region ("anti-GITR.g1.1f"), an IgG2 constant region ("anti-GITR-G2"), an IgG2 hinge and IgG1 Fc domain ("anti-GITR.G2.G1f"), and an IgG2 hinge and effectorless IgG1 Fc domain ("anti-GITR.G2.G1.1f").

First, the binding affinities of these GITR antibodies were compared to those of GITR antibodies having an IgG1 hinge. The binding affinities were determined as described in Example 2. As shown in FIG. 57, all three GITR antibodies having an IgG2 hinge had similar affinities for activated T cells as the two GITR antibodies having an IgG1 or IgG1.1 constant region.

Figure 58A:
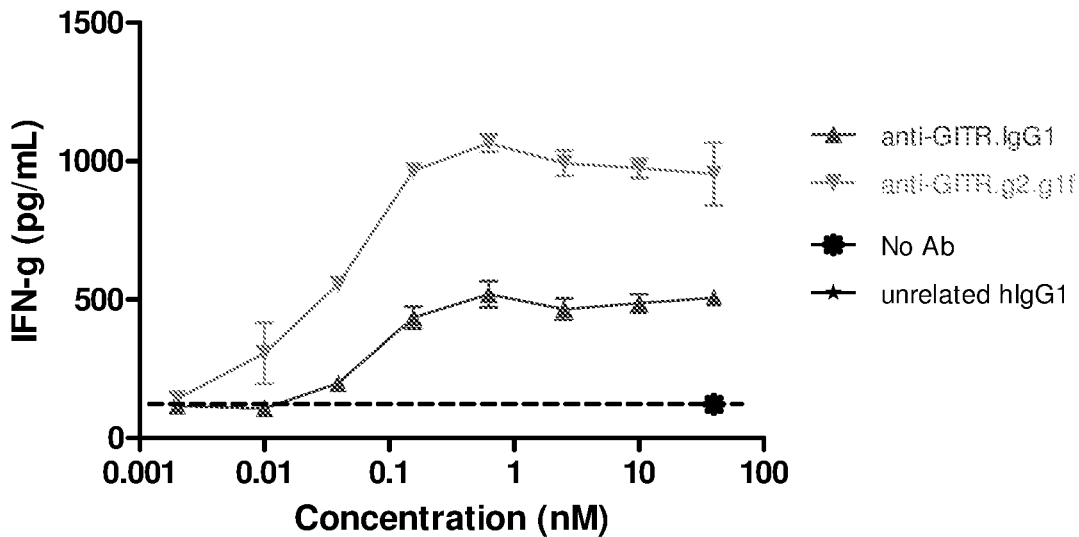
FIGS. 58A-58C show the secretion of IFN-γ and IL-2 from donor CD4 T cells stimulated with soluble anti-human GITR antibodies with different heavy chain constant regions.
Figure 58B:
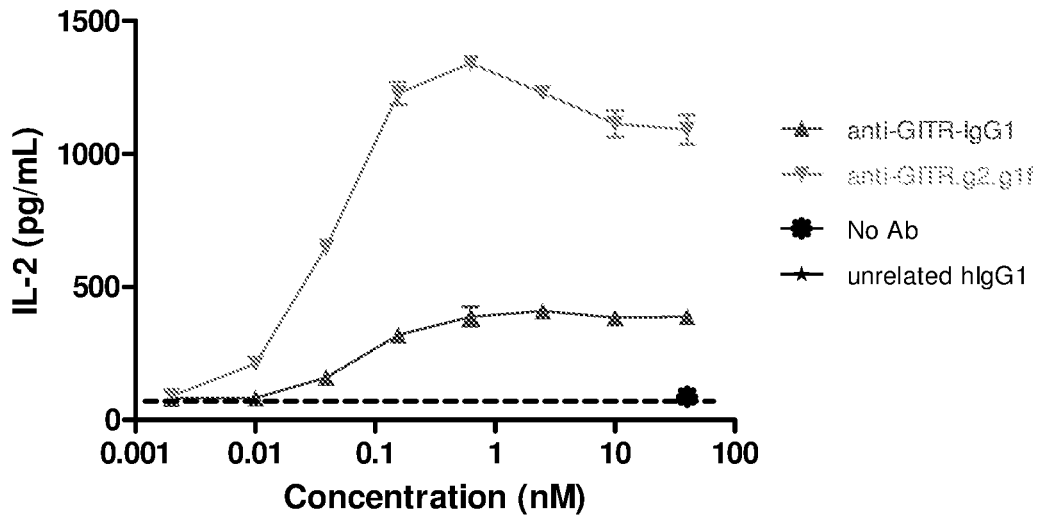
Figure 58C:
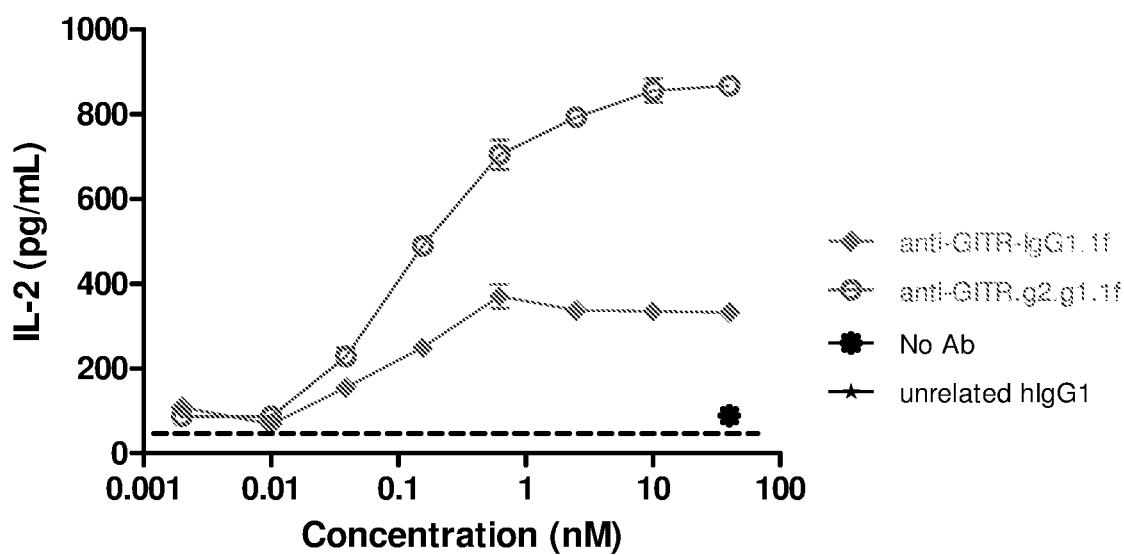

Next, the ability of GITR antibodies having an IgG1 constant region or IgG2 hinge/IgG1 Fc domain were tested for their ability to induce IL-2 and IFN-γ secretion from T cells stimulated with OKT3-expressing CHO cells, as described in Example 13. As shown in FIGS. 58A and 58B, the antibody with the IgG2 hinge/IgG1 Fc domain ("anti-GITR.G2.g1f") induced both IFN-γ and IL-2 secretion from T cells to a higher degree than the antibody with the IgG1 constant region ("anti-GITR.g1f"). Similar results were obtained with the effectorless versions of these constant domains (FIG. 58C).

Figure 59:
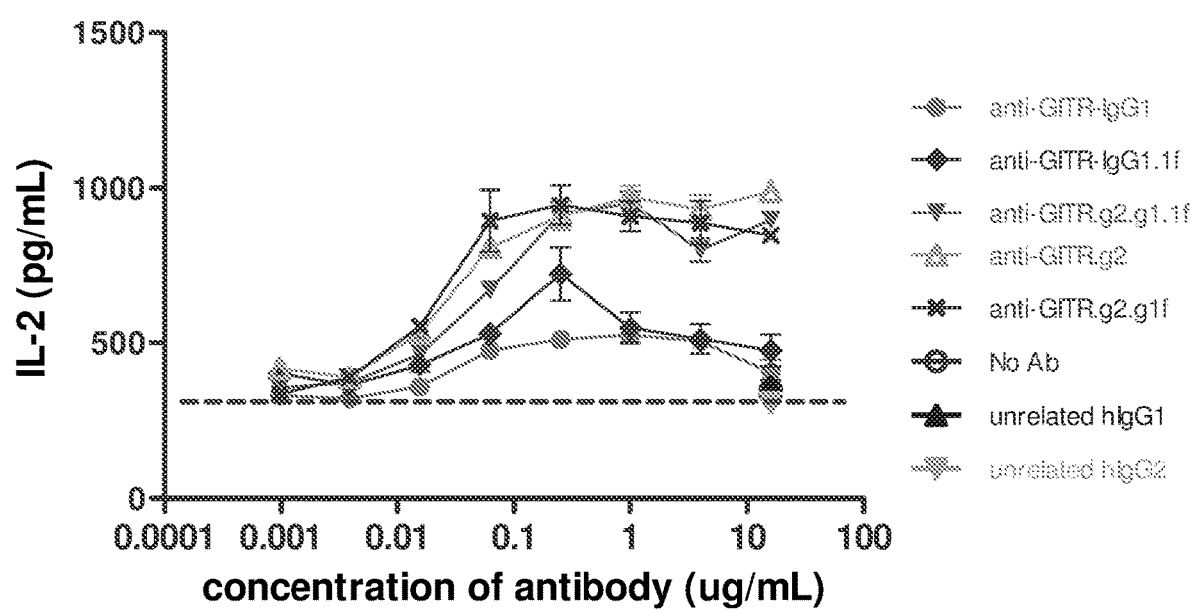
FIG. 59 shows a comparison of the indicated anti-GITR antibodies on IL-2 secretion from 3A9-hGITR cells in the presence of plate bound anti-CD3.

To further confirm the increased activation of T cells with the anti-GITR antibodies comprising an IgG2 hinge, IL-2 secretion in a different experimental format was tested. In this experiment, the ability of GITR antibodies to induce IL-2 secretion from 3A9-hGITR cells (mouse T cell hybridoma 3A9 cell line ectopically expressing human GITR) was tested, as described in Example 13. As shown in FIG. 59, all antibodies having the IgG2 hinge (anti-GITR.g2, anti-GITR.g2.g1f, and anti-GITR.g2.g1.1f) induced IL-2 secretion from 3A9-hGITR cells to a higher degree than their IgG1 constant region containing counterparts (anti-GITR.g1f and anti-GITR.g1.1f").

These results collectively suggest that anti-GITR antibodies having an IgG2 hinge and g1 or g1.1 constant regions are Example 21: Anti-GITR Antibody Induced Proliferation is Teff Cell-Intrinsic GITR is expressed on both mouse and human regulatory T (Treg) cells. Data in the literature have shown that agonistic anti-GITR antibodies drive the proliferation of mouse CD4+Foxp3− T effector (Teff) cells in the presence of Treg cells. Additionally, it has been suggested that this effect is driven primarily through anti-GITR antibody binding to Teff cells rather than direct effects on Treg cell suppressor function. Other publications show that anti-GITR antibodies drive Treg cell proliferation and may induce Treg cell lineage instability characterized by loss of Foxp3.

To examine the effects of anti-GITR antibodies on Treg cell function, a mouse Treg cell suppression assay was conducted in which Teff cells were stimulated with anti-CD3 and various isotypes of the anti-mouse GITR mAb DTA-1 in the presence of APCs and titrating numbers of Treg cells. The results showed that DTA-1 antibody treatment increased proliferation compared to an isotype control. Furthermore, the IgG1, 2a, 2b, and inert IgG1 D265A isotypes were all effective in increasing Teff cell proliferation, thereby demonstrating that FcR binding is not required for anti-GITR antibody function in this system.

From the previous experiment it was not clear whether the increased Teff proliferation was due to the anti-GITR antibodies acting on Treg and/or Teff cells. To address this question, human GITR "knock-in" (huGITR KI) mice were used. In these mice, the gene encoding mouse GITR, Tnfrsf18, was replaced with the human TNFRSF18 gene, and human GITR is expressed similarly to muGITR in wildtype mice; human GITR is expressed on both Teff and Treg cells with higher levels on the latter. It was found that the anti-human GITR mAb 28F3 was capable of driving proliferation of Teff cells from huGITR KI mice. Because 28F3 binds to human GITR but not mouse GITR, it was possible to set up a Treg suppression assay system in which GITR could be differentially targeted on Teff and Treg cells. This system also allowed the examination of the functional differences between 28F3 with either a human IgG1 or inert IgG1.1 Fc region.

Treg and Teff cells were sorted based on CD4 and CD25 expression from huGITR KI and WT mice. WT and huGITR Treg and Teff cells were mixed in combinations that allowed unicompartmental targeting of either Treg or Teff cells with 28F3 (huGITR KI Teff cells with wildtype Treg cells, etc.). As controls, conditions in which 28F3 could bind to both Treg and Teff cells or to neither were included. The Teff and Treg cell-containing cultures were stimulated with anti-CD3 in the presence of APCs and either 28F3 IgG1, 28F3 IgG1.1, or an isotype control.

Figures 60A, 60B:
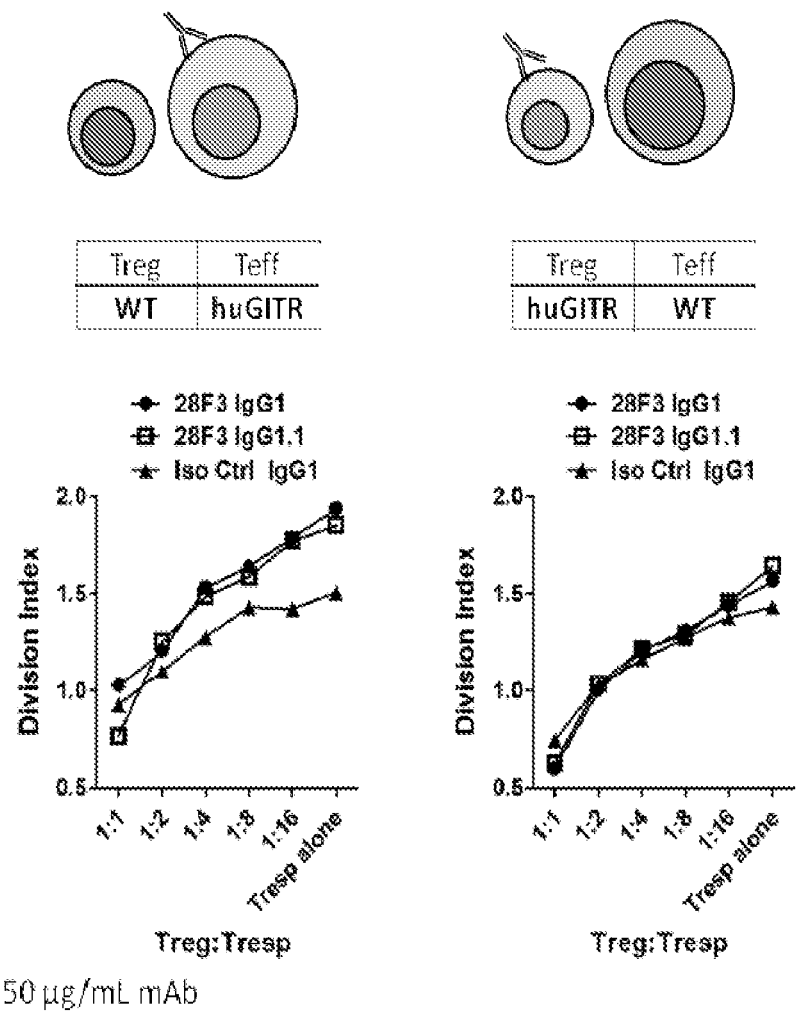
FIGS. 60A-60D show the effect of 28F3.IgG1 and 28F3.IgG1.1 on the proliferation of Treg and Teff cells.
Figure 60C:
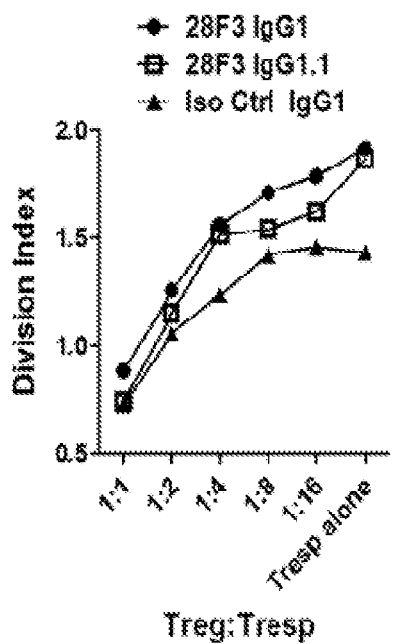
Figure 60D:
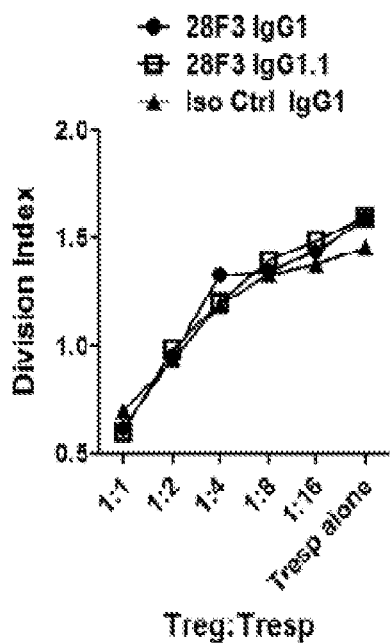

The results are provided in FIG. 60. As expected, an increase in Teff cell proliferation was observed when 28F3 could bind both Treg and Teff cells, and this effect was maintained in the condition in which 28F3 could only bind Teff cells. In contrast, when 28F3 was only able to bind Treg cells, there was no increase in Teff proliferation over the isotype control. With regard to isotype, there was no difference between the IgG1 and IgG1.1 Fc in the conditions where 28F3 showed an effect. This is consistent with the data described above showing that Fc cross-linking is not required for anti-GITR agonism. Taken together, in this system, anti-GITR antibodies acts primarily through its ability to modulate Teff cell function and not through inhibition of Treg cell suppressor capability. However, this does not exclude a role for GITR signaling on Treg cells in vivo, as anti-GITR antibodies may drive Treg cell proliferation or provide a Treg-specific target for ADCC or ADCP.

Example 22: Antibody-Dependent Cell-Mediated Cytotoxicity (ADCC)

The in vitro ADCC activity of 28F3.IgG1f and 28F3.IgG1.1f was assessed using either NK92/CD16 cells or primary NK cells as effectors and a variety of cells known to express GITR were used as targets.

Three days prior to assay, target CD4+ and CD8+ T cells subsets were isolated by negative selection and Tregs were further isolated from the CD4+ T cells by CD25 positive selection. Each of the T cell subsets was stimulated for three days with CD2/CD3/CD28 beads (Miltenyi Biotec) to induce upregulation of GITR. One day prior to assay, primary NK cells were isolated from fresh PBMCs by negative selection (StemCell Technologies, Inc) and incubated overnight in MyeloCult H5100 media (StemCell) supplemented with 500 IU/mL recombinant IL-2 (R&D Systems) and 1 uM hydrocortisone (StemCell). On day of assay, effector cells (primary NK cells or NK92/CD16) were incubated with Calcein AM-labeled activated T cells at specified effector to target ratios in the presence of 1 ug/mL 28F3.IgG1f and 28F3.IgG1.1f.

Using either primary NK cells or NK92/CD16 cells as effectors, 28F3.IgG1 induced lysis of activated CD4+ T effectors and Treg cells, while less lysis of activated CD8+ T cells was observed (FIG. 61). As expected, 28F3.IgG1.1 did not mediate ADCC of any target cells using either NK92 or primary NK cells as effectors. Thus, 28F3.IgG1 induced lysis of activated CD4+T effectors and Treg cells and to a lower extent, activated CD8+ T cells and the level of lysis induced by 28F3.IgG1 appears to be proportional to the level of GITR expression on the target cells.

Example 23: Activity of 28F3.IgG1 Antibody in Human GITR Knock-In Mice

This Example shows that 28F3.IgG1 and 28F3IgG1.1 have antitumor activity in MC38 tumors in C57BL/6 mice having a human immune system and human GITR protein, and that antitumor activity is stronger with 28F3.IgG1.

Generation of Human GITR Knock-In Mice:

C57BL/6 mice were genetically engineered to express the human GITR extracellular domain (ECD) in place of the mouse GITR ECD, keeping intact the mouse transmembrane and cytoplasmic sequences. Expression of the human/mouse chimeric GITR was confirmed by staining of anti-CD3/CD28– activated spleen cells with an anti-human GITR antibody.

MC38 cells were cultured in DMEM medium with 10% heat inactivated fetal bovine serum (FBS), 2 mM L-glutamine, 4.5 g/L (45%) glucose (10 mL/L), and 1 mM sodium pyruvate (10 mL/L). Cells were split 1:10 every 2 days. Two cohorts of mice were used, and for both cohorts, the right flank of each mouse was subcutaneously implanted with 0.75 million MC38 cells in 0.2 mL PBS, using a 1-cm$^3$ syringe and a 25-gauge half inch needle. For cohort 1, on Day 7 post implantation, 40 mice were randomized to 3 groups of 12-13 mice each according to tumor volume (L×W×H/2). All groups had average tumor volumes of approximately 174 mm$^{3/2}$. On Days 7, 10, and 14, vehicle control or mAb was administered at 10 mg/kg. For cohort 2, on Day 7 post implantation, 10 mice were randomized to 2 groups of 5 mice each according to tumor volume (L×W×H/2). All groups had average tumor volumes of approximately 69 mm$^{3/2}$. On Days 7, 10, and 14, vehicle control or 28F3.IgG1 mAb was administered at 10 mg/kg.

Mice were dosed intraperitoneally (IP) at the concentrations and dates summarized in Table 9.

TABLE 9

| Groups | Post-Implantation Days |
| --- | --- |
| IgG1 Isotype, 10 mg/kg | 7, 10, and 14 |
| 28F3.IgG1, 10 mg/kg | 7, 10, and 14 |
| 28F3.IgG1.1f, 10 mg/kg | 7, 10, and 14 |

Tumors and body weights were measured twice weekly through study termination. Tumors were measured in 3 dimensions with a Fowler Electronic Digital Caliper (Model 62379-531; Fred V. Fowler Co., Newton, Mass.), and data was electronically recorded using StudyDirector software from Studylog Systems, Inc. (South San Francisco, Calif.).

In this tumor study, Cohort 1 was terminated on Day 52 post implantation. Microsoft Excel was used to calculate the mean, standard deviation (SD), and median values of tumor volumes and body weights. The mean and median values were calculated when 100% and at least 60% of the study animals remained in each treatment group, respectively. Tumors from mice in Cohort 2 were harvested on Day 15.

Figure 62A:
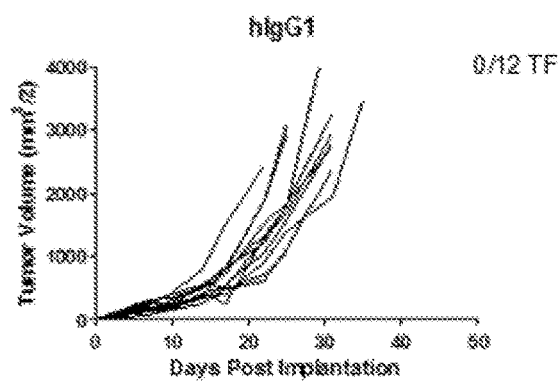
FIGS. 62A-62C show the effect of a control hIgG1 antibody, 28F3.IgG1 ("anti-GITR IgG1"), and 28F3.IgG1.1 (anti-GITR IgG1.1") on the growth of MC38 tumors.
Figure 62B:
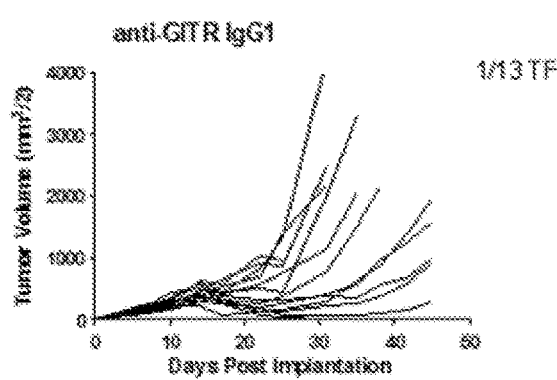
Figure 62C:
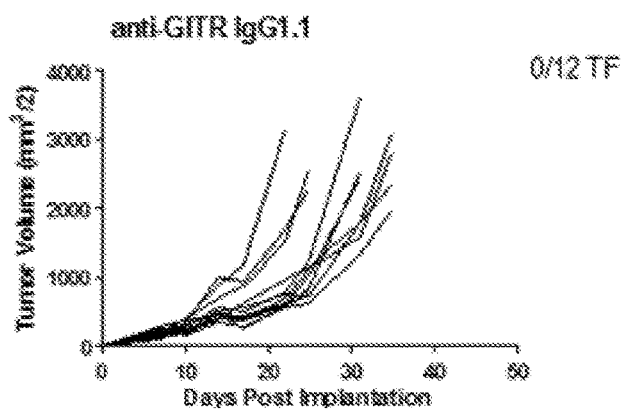

The results indicate that, at Day 22 post tumor implantation, the last day when all mice in study were alive, the 10 mg/kg dose of 28F3.IgG1 showed 67% mean tumor growth inhibition (TGI) on MC38 xenografts compared to the isotype control antibody. Tumor TGI is summarized by treatment group in Table 10. Tumor growth curves by treatment group are shown in FIGS. 62A-62C. Mean and median tumor growth curves by treatment group are presented in FIGS. 63A-63B. No toxicity was apparent in any treatment group as the mean and median body weight changes were less than 20%. Mouse body weights and percentage changes over time are shown in FIGS. 64A-64B.

TABLE 10

| Treatment Group | Day 22 | | Day 25 | |
| --- | --- | --- | --- | --- |
| | Mean Tumor Volume (mm³) | TGI (%) | Median Tumor Volume (mm³) | TGI (%) |
| Isotype IgG1, 10 mg/kg | 1342 | N/A | 1790 | N/A |
| 28F3.IgG1, 10 mg/kg | 447 | 67 | 380 | 79 |
| 28F3.IgG1.1f, 10 mg/kg | 1049 | 22 | 1064 | 41 |

The results show that 28F3.IgG1 had 67% TGI while 28F3.1gG1.1f had 22% TGI at Day 22 post implantation, indicating that both antibodies reduced tumor growth in the MC38 tumor model. In addition, the results suggest that Fc binding by 28F3.IgG1 enhances anti-tumor potency in the MC38 tumor model.

To investigate the effect that 28F3.IgG1 has on T cell populations, tissues were harvested from 5 mice in each treatment group on Day 15 post implantation. Spleens and tumors were processed on a gentleMACS Octo Dissociator™ (Miltenyi, San Diego, Calif.). Single cell suspensions were stained for T cell markers using flow cytometry (FACS). Antibody fluorescence was detected by flow cytometry on the Fortessa (BD Biosciences, San Jose, Calif.) and the results were analyzed with the computer program, Flowjo (Flowjo, LLC, Ashland, Oreg.).

Figure 65:
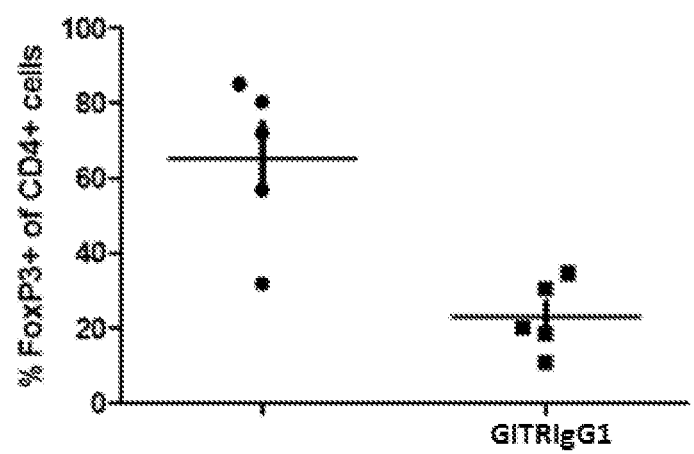
FIG. 65 shows the effects of 28F3.IgG1 ("GITR IgG1"), relative to isotype control, on the depletion of Treg cells in the MC38 tumor model.
Figure 66:
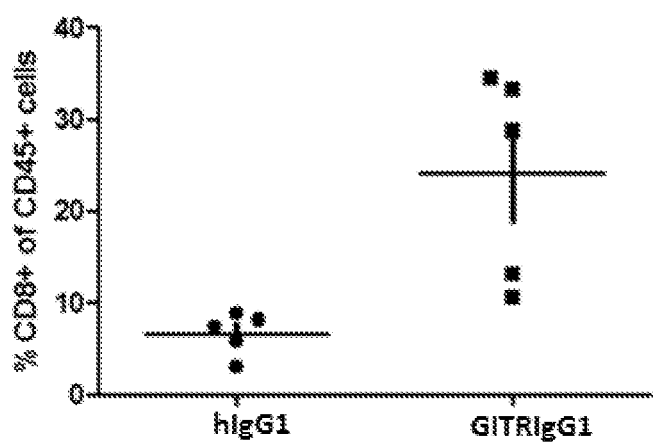
FIG. 66 shows the effects of 28F3.IgG1 ("GITR IgG1"), relative to isotype control, on the percentage of CD8+ T cells in the MC38 tumor model.

The results, which are shown in FIGS. 65 and 66, show reduced percentage of Treg cells, consistent with depletion in the mice treated with 28F3.IgG1 relative to isotype control (FIG. 65) Conversely, there was an increase in the percentage of CD8+ T cells in the 28F3.IgG1 group (FIG. 66).

Thus, immuno-monitoring in mice treated with 28F3.IgG1 as compared to the isotype control suggests TGI may be mediated by Treg depletion and an increase in CD8+ T cells.

Example 24: Cross-Linking 28F3.IgG1 Increases its Potency

This Example shows that cross-linking 28F3.IgG1 increases its potency to enhance IFN-γ secretion of T cells and promote T cell proliferation.

T cells were co-cultured with either CHO-OKT3 cells or CHO-OKT3-CD32a$^{high}$ in the presence of various concentrations of anti-GITR antibodies or control reagents, and the levels of interferon-γ (IFN-γ) secretion and cell proliferation were measured. The CHO-OKT3-CD32$^{high}$ cell line has a very high level of Fc receptor CD32a, and slightly higher OKT3 expression than its parental CHO-OKT3 clone.

Figure 67:
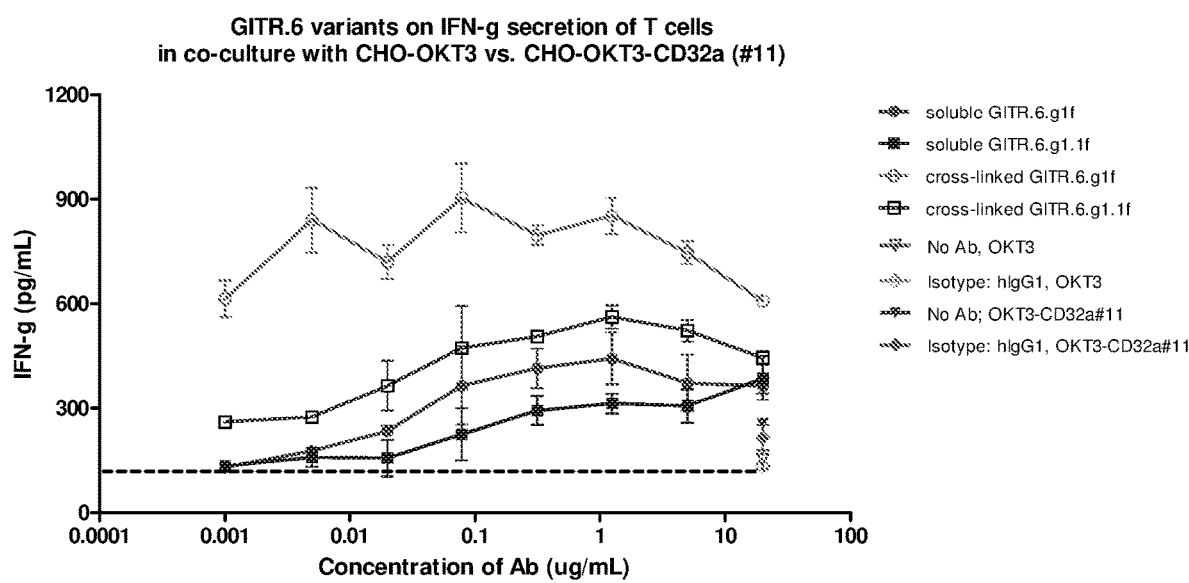
FIG. 67 shows the effect of soluble and cross-linked 28F3.IgG1 ("GITR.6IgG1") and 28F3.IgG1.1 ("GITR.6IgG1.1") on IFN-γ secretion from T cells when co-cultured with CHO-OKT3 and CHO-OKT3-CD32a cells.
Figure 68:
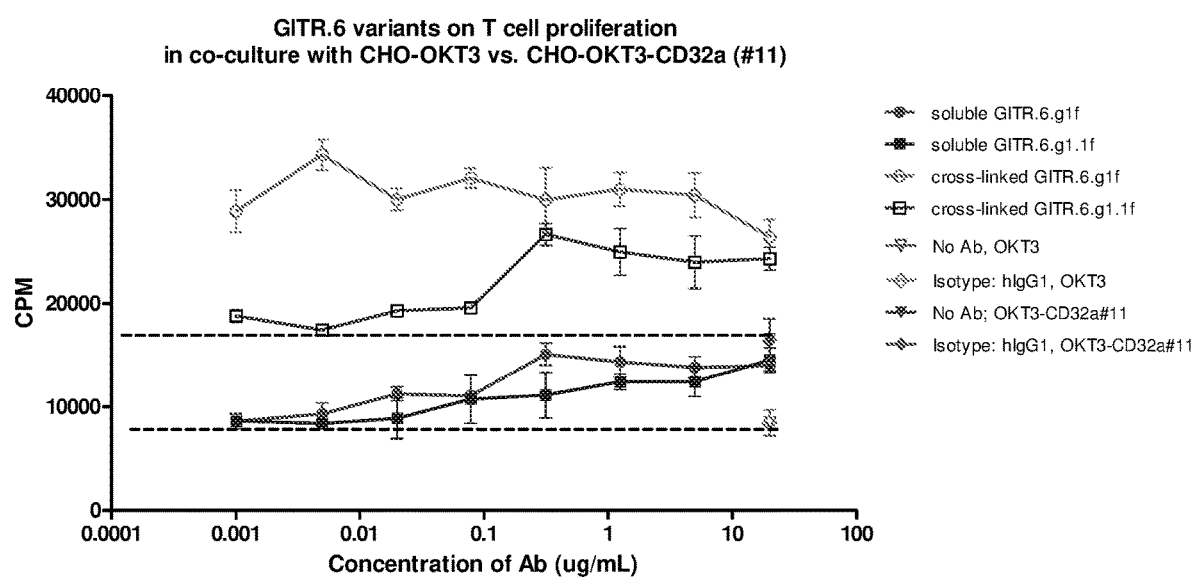
FIG. 68 shows the effect of soluble and cross-linked 28F3.IgG1 ("GITR.6IgG1") and 28F3.IgG1.1 ("GITR.6IgG1.1") on T cell proliferation when co-cultured with CHO-OKT3 and CHO-OKT3-CD32a cells.

The assay was conducted as follows. Responder T cells were obtained from human PBMCs isolated from Ficoll gradient (Amersham Bioscience 17-1440-03) with CD4 T cells isolation kit (Life technologies, Cat. 113.31D) and CD25 Microbeads (Miltenyi, Cat. 130-092-983) according to manufacturer's protocol. CHO cells expressing anti-CD3scFv (OKT3) (CHO-OKT3) or CHO cells expressing anti-CD3scFv and CD32a washed twice with RPMI medium were subjected to irradiation with a dosage of 50K Rad. Cells were harvested and resuspended in culture medium (RPMI-1640 supplemented with 10% Fetal Bovine Serum, 2 mM L-glutamine, 55 nM β-Mercaptoethanol, 1 mM sodium pyruvate, and 100U/mL Penicillin/streptomycin) at 2.5×10⁵/mL. 2.5×10⁴ CHO cells and 1×10⁵ T cells were seeded per well in a 96-well TC grade flat-bottom plate (Costar). Cells were incubated with an 8-point, 4-fold titration of GITR antibody starting at 20 µg/mL. An unrelated hIgG1 was added at 20 µg/mL as the isotype control. A sample with cells only was included to show baseline activity without any treatment. Supernatant from each sample was harvested at day 3 for IFN-γ measurement (BD optEIA human IFN-g ELISA Kit; BD Bioscience #555142). Cell proliferation was assessed by ³H-thymidine incorporation for the last 8-hours of incubation. The results, which are shown in FIGS. 67 and 68, indicate that, in the presence of 28F3.IgG1, more IFN-γ is secreted from the T cells that were co-cultured with CHO-OKT3-CD32a$^{high}$ relative to those that were co-cultured with CHO-OKT3 cells (FIG. 67). As expected, no significant difference was observed with the effectorless 28F3.IgG1.1f antibody, which does not bind to CD32a. In addition, in the presence of 28F3.IgG1, more T-cell proliferation was observed in T cells that were co-cultured with CHO-OKT3-CD32a$^{high}$ relative to those that were co-cultured with CHO-OKT3 cells; this effect was not observed with the effectorless 28F3.IgG1.1f antibody (FIG. 68). Thus, cross-linking 28F3.IgG1 increases its potency to enhance IFN-γ secretion of T cells and promote T cell proliferation. This potentiating effect was also seen on T cell proliferation with CHO-OKT3 cells expressing lower levels of CD32a. GITR.6 g1.1f shows higher levels of IFN-γ when cross-linked compared to when soluble. This is likely a reflection of a slightly higher level of OKT3 expressed on CHO-OKT3-CD32a$^{high}$ cells relative to CHO-OKT3 cells. The increase observed with cross-linked GITR.6 g1f is greater than that observed with the inert isotype, suggesting a positive benefit for cross-linking. The G1f version promotes high levels of IFN-γ even at low doses where the soluble antibodies demonstrated little agonism over background, again suggesting a positive role of cross-linking.

Thus, both 28F3.IgG1 and the effectorless 28F3.IgG1 antibodies stimulate the production of IFN-γ and stimulate T cell proliferation, however, cross-linking 28F3.IgG1 further increases its potency to enhance IFN-γ secretion of T cells and to promote T cell proliferation.

Example 25: IgG2 CH1 Enhances GITR Ab Induced IL-2 Secretion by CD4+ T Cells

This Example shows that a CH1 domain of the IgG2 isotype enhances anti-GITR antibody induced T cell activity, relative to the antibody with a CH1 domain of the IgG1 isotype.

The modified heavy chain constant regions shown in Table 11 were linked to the variable regions of the anti-GITR antibody. Donor CD4+ T cells were incubated with OKT3-scFv expressing CHO cells and the various anti-GITR antibodies, and the level of IL-2 secreted was measured. This was conducted as described in Example 20.

TABLE 11

Modified heavy chain constant regions:

| Constructs | SEQ ID NO of constant region | Description |
|---|---|---|
| IgG1f | 383 | wild type IgG1f |
| IgG1.1f | 388 | standard inert IgG1.1f |
| IgG2.3 | 384 | IgG2 A-form (C219S) |
| IgG2.5 | 387 | IgG2 B-form (C131S) |
| IgG2.3G1-KH | 386 | CH1, upper hinge and lower hinge/upper CH2 of IgG2.3, all else IgG1f |
| IgG2.5G1-KH | 395 | CH1, upper hinge and lower hinge/upper CH2 of IgG2.5, all else IgG1f |
| IgG2.3G1-AY | 385 | CH1 and upper hinge of IgG2.3, all else IgG1f |
| IgG2.5G1-AY | 394 | CH1 and upper hinge of IgG2.5, all else IgG1f |
| IgG1-G2.3G1-KH | 398 | CH1 of IgG1, upper hinge and lower hinge/upper CH2 of IgG2.3, all else IgG1f |
| IgG1-G2.3G1-AY | 397 | CH1 of IgG1, upper hinge of IgG2.3, all else IgG1f |
| IgG2.3G1.1f-KH | 389 | CH1, upper hinge and lower hinge/upper CH2 of IgG2.3, all else IgG1.1f |
| IgG2.5G1.1f-KH | 393 | CH1, upper hinge and lower hinge/upper CH2 of IgG2.5, all else IgG1.1f |
| IgG1-deltaTHT | 390 | IgG1 with THT sequence removed from hinge |
| IgG2.3-plusTHT | 391 | IgG2.3 with THT sequence (from IgG1) added into hinge |
| IgG2.5-plusTHT | 396 | IgG2.5 with THT sequence (from IgG1) added into hinge |
| IgG2.3-plusGGG | 392 | IgG2.3 with flexible GGG sequence added into hinge |

Figure 69:
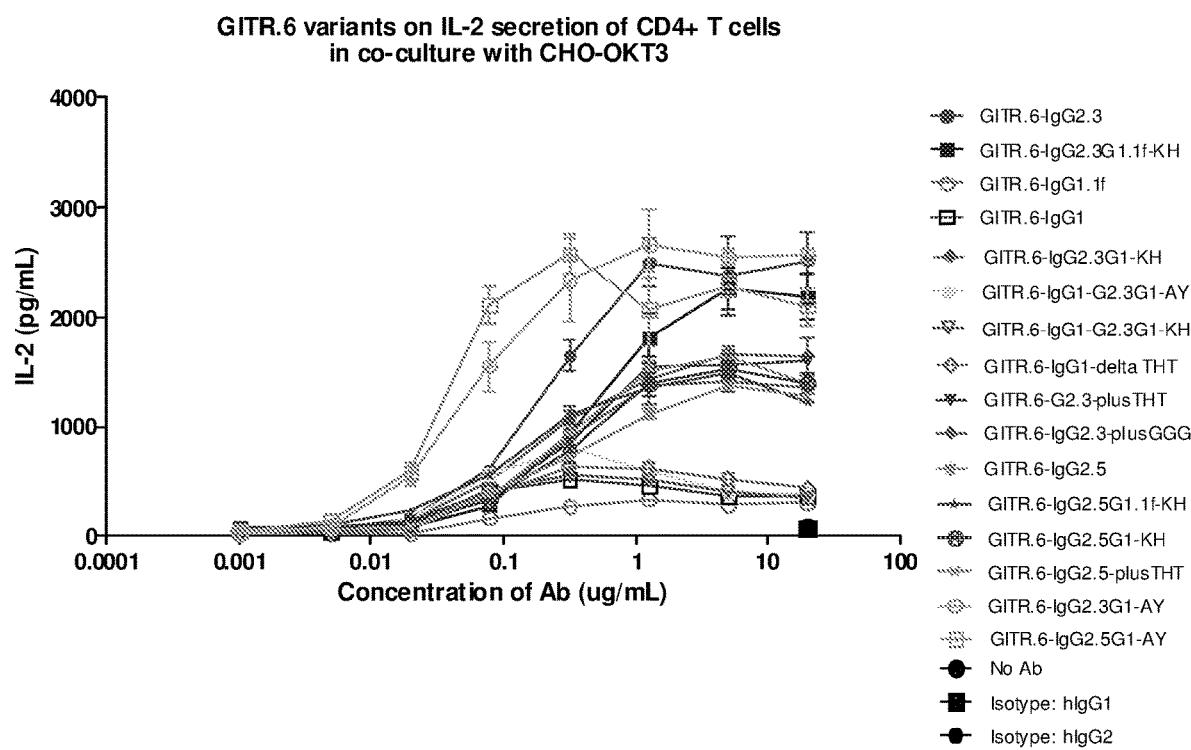
FIG. 69 shows the level of IL-2 secreted by CD4+ T cells co-cocultured with CHO-OKT3 cells in the presence of an anti-GITR antibody having the indicated constant regions.

The results, which are shown in FIG. 69, indicate that all anti-GITR antibodies having a CH1 domain of the IgG2 isotype, in addition to a hinge of the IgG2 isotype, are more effective at stimulating IL-2 secretion from CD4+ T cells than those having an IgG1 hinge and CH1.

Thus, this Example shows that the presence of an IgG2 hinge and IgG2 CH1 domain in an agonist anti-GITR antibody further enhances the agonist activity of the antibody relative to the same antibody that does not have a hinge and/or a CH1 domain of the IgG2 isotype. An antibody having both a hinge and a CH1 domain of the IgG2 isotype has a stronger agonist effect relative to an antibody having a hinge, but not CH1, of the IgG2 isotype. Additionally, an antibody with a CH1 domain from IgG2 has a stronger agonist activity than an antibody with with a CH1 domain from IgG1 isotype. An antibody with a hinge from IgG2 and a CH1 domain from IgG1 has stronger agonist activity than an antibody with a CH1 and hinge from IgG1 isotype.

Example 26: Fc Receptor Binding for Antibodies with Engineered Constant Domains

This Example demonstrates that antibodies having modified heavy chain constant regions comprising the CH1 and hinge of IgG2 bind to FcγRs when they contain CH2 and CH3 domains of IgG1.

In addition to antigen binding by the variable domains, antibodies can engage Fc-gamma receptors (FcgRs) through interaction with the constant domains. These interactions mediate effector functions such as antibody-dependent cellular cytotoxicity (ADCC) and antibody-dependent cellular phagocytosis (ADCP). Effector function activity is high for the IgG1 isotype, but very low or absent for IgG2 and IgG4 due to these isotypes having lower affinity for FcgRs. In addition, the effector function of IgG1 can be modified through mutation of amino acid residues within the constant regions to alter FcgR affinity and selectivity.

The binding of antibodies to Fc gamma receptors (FcγRs or FcgRs) was studied using biosensor technologies including Biacore surface plasmon resonance (SPR) and Fortebio Biolayer Interferometry (BLI). SPR studies were performed on a Biacore T100 instrument (GE Healthcare) at 25° C. The Fab fragment from a murine anti-6×His antibody was immobilized on a CM5 sensor chip using EDC/NHS to a density of ~3000 RU. Various his-tagged FcgRs (7 ug/ml) were captured via the C-terminal his-tag using a contact time of 30 s at 10 ul/min, and the binding of 1.0 uM antibody was evaluated in a running buffer of 10 mM NaPO4, 130 mM NaCl, 0.05% p20 (PBS-T) pH 7.1. FcgRs used for these experiments included CD64 (FcgRI), CD32a-H131 (FcgRIIa-H131), CD32a-R131 (FcgRIIa-R131), CD32b (FcgRIIb), CD16a-V158 (FcgRIIIa-V158), CD16b-NA1 (FcgRIIIb-NA1), and CD16B-NA2 (FcgRIIIb-NA2). BLI experiments were performed on a Fortebio Octet RED instrument (Pall, Fortebio) at 25° C. in 10 mM NaPO4, 130 mM NaCl, 0.05% p20 (PBS-T) pH 7.1. Antibodies were captured out of undiluted expression supernatants on protein A coated sensors, followed by the binding of 1 µM hCD32a-H131, hCD32a-R131, hCD32b, hCD16a-V158, or 0.1 µM hCD64 analytes.

Figure 70:
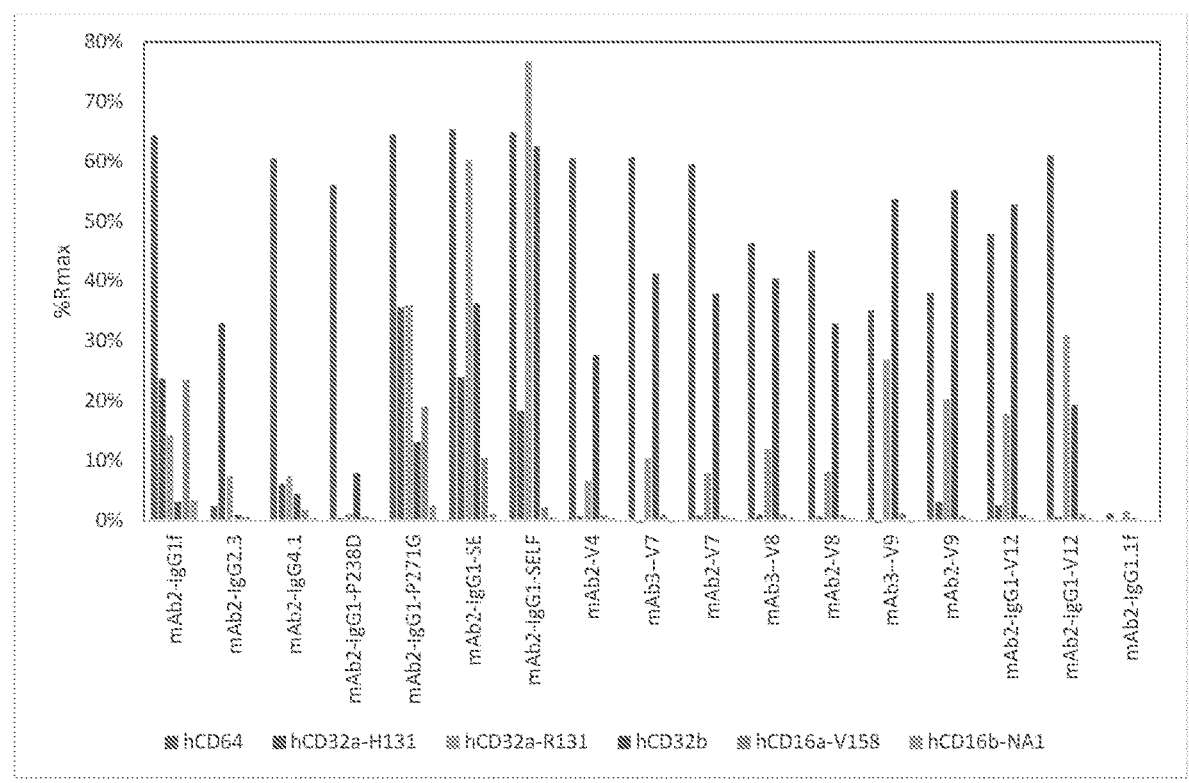
FIG. 70 shows antibody binding to anti-his Fab captured FcγR-his proteins. Binding responses are plotted as a percentage of the theoretical Rmax assuming a 1:1 mAb:FcγR binding stoichiometry. The bars for each antibody are shown in the order provided by the color legends at the bottom of the slide.

First, antibodies were made that contain modified IgG1 Fc domains including the substitutions S267E (SE) and S267E/L328F (SELF), as well as various combinations of the mutations P238D, P271G, H268D, A330R, G237D, E233D, referred to as V4, V7, V8, V9 and V12. The binding of these antibodies was studied by Biacore SPR with comparison to IgG1f, IgG2.3 (IgG2-C219S) and IgG4.1 (IgG4-S228P) antibodies, as well as an IgG1.1f antibody which has been engineered to reduce binding to all FcgRs. The results, which are shown in FIG. 70, demonstrate the expected FcgR binding properties for IgG1f, IgG2.3 and IgG4.1 and the mutated IgG1 antibodies, including increased CD32a-H131, CD32a-R131 and CD32b binding for SE and SELF, as well as increased selectivity of the V4, V7, V8, V9 and V12 mutants for CD32b over CD32a-H131 and CD32a-R131 (FIG. 70).

Figure 71:
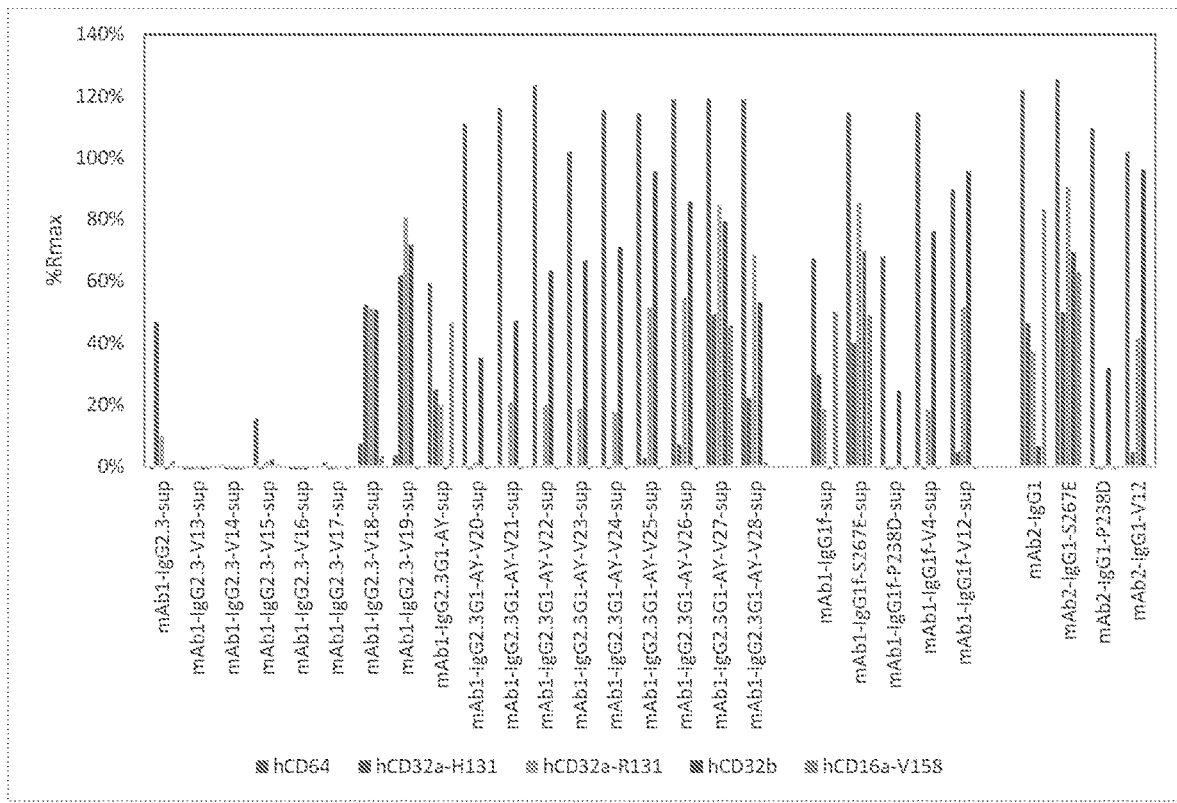
FIG. 71 shows antibody binding to anti-his Fab captured FcgR-his proteins. Binding responses are plotted as a percentage of the theoretical Rmax assuming a 1:1 mAb:FcγR binding stoichiometry. The bars for each antibody are shown in the order provided by the color legends at the bottom of the slide.

The next set of constructs were used to engineer effector function into the otherwise effector function negative IgG2 isotype. For this study, the mutations described above were introduced in the context of IgG2.3 constant region, or an IgG2.3/IgG1f hybrid termed IgG2.3G1-AY (Table 12). Antibodies were expressed at small scale as supernatants, and tested for binding to FcgRs using Fortebio Octet BioLayer Interferometry biosensor technology. Since the antibodies were present at low concentration in the supernatants, the experiment was performed by capturing antibodies out of the supernatants using protein A coated sensors, followed by binding of FcgR analytes in solution. Purified and supernatant control IgG1f including wild type IgG1, SE, P238D, V4 and V12 antibodies were also included for comparison, and each of these control antibodies demonstrated expected FcgR binding properties (FIG. 71). The IgG2.3 antibody also demonstrated the expected binding profile, with appreciable binding to only CD32a-H131. However, all mutations to introduce S267E, L328F, P238D, P271G, H268D, A330R, G237D, or E233D mutations into IgG2.3 failed to recapitulate the FcgR affinity of the corresponding engineered IgG1 mAbs (FIG. 71). In contrast, the IgG2.3G1-AY construct was able to fully preserve the FcgR binding properties of wild type IgG1, while retaining the CH1 and hinge regions of IgG2.3. In addition, all IgG2.3G1-AY mutants containing S267E, L328F, P238D, P271G, H268D, A330R, G237D, and E233D demonstrated FcgR binding properties comparable to the IgG1 version mAbs containing the same mutations (FIG. 71). This demonstrates the successful engineering of antibodies with CH1 and hinge regions of IgG2 combined with effector function of wild type or mutant IgG1.

B-form variants (IgG2.5G1-AY and IgG2.5G1-AY-V27), and other hybrid antibodies containing different combinations of IgG1 and IgG2 constant domains, and testing the binding of these antibodies to anti-his Fab captured his-tagged FcgRs using Biacore SPR technology. In agreement with the Octet supernatant data, the SPR data showed that the IgG2.3G1-AY and IgG2.3G1-AY-V27 antibodies had comparable FcgR binding properties to IgG1f and IgG1f-S267E respectively, despite containing the CH1 and hinge regions of an A-form IgG2 antibody (IgG2.3) (Table 13). Similar data was also obtained using IgG2.5G1-AY and IgG2.5G1-AY-V27 antibodies, demonstrating the successful engineering of B-form IgG2 antibodies (containing C131S mutation termed IgG2.5) having IgG1f or modified IgG1f like effector functions. Data for several other antibodies with IgG2.3G1-AY, IgG2.3G1-AY-V27, IgG2.5G1-AY, or IgG2.5G1-AY-V27 constant regions but different variable regions shows that this engineering strategy is broadly applicable to other antibodies independent of the variable domains (Table 13). Other constructs that demonstrate IgG1f-like FcgR binding properties are IgG1-G2.3G1-AY, and IgG1deltaTHT, whereas several of the modified constant region constructs were unable to retain IgG1f-like FcgR binding properties, including IgG2.3G1-KH, IgG2.5G1-KH, IgG2.3plusTHT, IgG2.5plusTHT and IgG2.3plusGGG constructs (Table 13).

TABLE 12

Engineered IgG2 constructs

| Set | ID | Construct | Seq ID# |
|---|---|---|---|
| 1 | IgG2.3 | hHC-IgG2-C219S | 384 |
|   | IgG2.3-V13 | hHC-IgG2-C219S - P238D | 431 |
|   | IgG2.3-V14 | hHC-IgG2-C219S - P238D, P271G | 432 |
|   | IgG2.3-V15 | hHC-IgG2-C219S - P238D, H268D, P271G | 433 |
|   | IgG2.3-V16 | hHC-IgG2-C219S - P238D, P271G, A330R | 434 |
|   | IgG2.3-V17 | hHC-IgG2-C219S - P238D, H268D, P271G, A330R | 435 |
|   | IgG2.3-V18 | hHC-IgG2-C219S - S267E | 436 |
|   | IgG2.3-V19 | hHC-IgG2-C219S - S267E, L328F | 437 |
| 2 | IgG2.3G1 | hHC-IgG2-C219S/hHC-IgG1f | 385 |
|   | IgG2.3G1-AY-V20 | hHC-IgG2-C219S/hHC-IgG1f - P238D | 438 |
|   | IgG2.3G1-AY-V21 | hHC-IgG2-C219S/hHC-IgG1f - P238D, P271G | 439 |
|   | IgG2.3G1-AY-V22 | hHC-IgG2-C219S/hHC-IgG1f - P238D, H268D, P271G | 440 |
|   | IgG2.3G1-AY-V23 | hHC-IgG2-C219S/hHC-IgG1f - P238D, P271G, A330R | 441 |
|   | IgG2.3G1-AY-V24 | hHC-IgG2-C219S/hHC-IgG1f - P238D, H268D, P271G, A330R | 442 |
|   | IgG2.3G1-AY-V25 | hHC-IgG2-C219S/hHC-IgG1f - G237D, P238D, H268D, P271G, A330R | 443 |
|   | IgG2.3G1-AY-V26 | hHC-IgG2-C219S/hHC-IgG1f - E233D, G237D, P238D, H268D, P271G, A330R | 444 |
|   | IgG2.3G1-AY-V27 | hHC-IgG2-C219S/hHC-IgG1f - S267E | 445 |
|   | IgG2.3G1-AY-V28 | hHC-IgG2-C219S/hHC-IgG1f - S267E, L328F | 446 |

This engineering strategy was further explored by producing other antibodies formatted with IgG2.3G1-AY, IgG2.3G1-AY-S267E (IgG2.3G1-AY-V27), as well as IgG2-

TABLE 13

% Rmax values for 1 uM antibodies binding to anti-his Fab captured FcgR-his proteins

| mAb | hCD64 | hCD32a-H131 | hCD32a-R131 | hCD32b | hCD16a-V158 | hCD16B-NA2 |
|---|---|---|---|---|---|---|
| mAb8-IgG1f | 80% | 82% | 51% | 27% | 51% | 21% |
| mAb9-IgG1f | 70% | 33% | 19% | 4% | 28% | 10% |
| GITR.6-IgG1f | 66% | 35% | 25% | 8% | 41% | 19% |
| GITR.6-IgG1.1f | 2% | 0% | 3% | 1% | 0% | 0% |
| mAb11-IgG2.3 | 2% | 44% | 17% | 5% | 1% | 0% |
| mAb6-IgG2.3 | 3% | 66% | 14% | 3% | 1% | 0% |
| GITR.6-IgG2.3 | 4% | 40% | 10% | 1% | 2% | 0% |

TABLE 13-continued

% Rmax values for 1 uM antibodies binding to anti-his Fab captured FcgR-his proteins

| mAb | hCD64 | hCD32a-H131 | hCD32a-R131 | hCD32b | hCD16a-V158 | hCD16B-NA2 |
|---|---|---|---|---|---|---|
| mAb4-IgG2.3 | 1% | 39% | 6% | 1% | 1% | 0% |
| mAb5-IgG2.3 | 6% | 100% | 30% | 4% | 3% | 0% |
| mAb12-IgG2.3 | 2% | 39% | 7% | 1% | 1% | 0% |
| mAb13-IgG2.3 | 2% | 40% | 7% | 1% | 1% | 0% |
| mAb11-IgG2.5 | 0% | 40% | 13% | 3% | 0% | −1% |
| mAb7-IgG2.5 | 4% | 72% | 19% | 2% | 2% | 0% |
| mAb8-IgG2.5 | 3% | 59% | 14% | 3% | 2% | 0% |
| mAb10-IgG2.5 | 1% | 29% | 5% | 1% | 1% | 0% |
| mAb6-IgG2.5 | 3% | 75% | 17% | 4% | 2% | 0% |
| GITR.6-IgG2.5 | 4% | 43% | 13% | 2% | 2% | 1% |
| mAb4-IgG2.5 | 2% | 46% | 8% | 1% | 1% | 0% |
| mAb5-IgG2.5 | 6% | 89% | 26% | 5% | 4% | 1% |
| mAb12-IgG2.5 | 1% | 36% | 6% | 1% | 1% | 0% |
| mAb13-IgG2.5 | −2% | 39% | 4% | −2% | 0% | −2% |
| mAb8-IgG2.3G1-AY | 77% | 61% | 38% | 10% | 38% | 13% |
| mAb10-IgG2.3G1-AY | 67% | 23% | 14% | 4% | 24% | 8% |
| GITR.6-IgG2.3G1-AY | 66% | 43% | 33% | 16% | 42% | 21% |
| mAb7-IgG2.5G1-AY | 80% | 73% | 45% | 12% | 47% | 19% |
| mAb8-IgG2.5G1-AY | 77% | 70% | 45% | 17% | 48% | 22% |
| GITR.6-IgG2.5G1-AY | 65% | 38% | 27% | 10% | 41% | 19% |
| GITR.6-IgG2.3G1-KH | 3% | 13% | 3% | 0% | 3% | 1% |
| GITR.6-IgG2.5G1-KH | 2% | 15% | 3% | 0% | 3% | 1% |
| GITR.6-IgG2.3G1.1f-KH | 2% | 9% | 2% | 0% | 1% | 0% |
| GITR.6-IgG2.5G1.1f-KH | 3% | 15% | 4% | 0% | 2% | 0% |
| mAb7-IgG2.3G1-AY-V27 | 84% | 68% | 92% | 76% | 26% | 7% |
| mAb8-IgG2.3G1-AY-V27 | 78% | 67% | 80% | 67% | 24% | 7% |
| mAb10-IgG2.3G1-AY-V27 | 69% | 24% | 57% | 40% | 12% | 3% |
| mAb7-IgG2.5G1-AY-V27 | 81% | 74% | 89% | 84% | 32% | 9% |
| mAb8-IgG2.5G1-AY-V27 | 77% | 76% | 79% | 77% | 33% | 10% |
| GITR.6-IgG1-G2.3G1-AY | 66% | 36% | 25% | 7% | 42% | 19% |
| GITR.6-IgG1-G2.3G1-KH | 2% | 21% | 2% | 0% | 5% | 1% |
| GITR.6-IgG1deltaTHT | 66% | 57% | 42% | 17% | 48% | 27% |
| GITR.6-IgG2.3plusTHT | 6% | 45% | 17% | 2% | 3% | 1% |
| GITR.6-IgG2.5plusTHT | 5% | 44% | 15% | 2% | 3% | 1% |
| GITR.6-IgG2.3plusGGG | 6% | 45% | 17% | 2% | 3% | 1% |

Taken together these data show that the sequence in IgG1 immediately C-terminal to the conserved CPPCPAP (SEQ ID NO: 479) motif in the hinge region confers FcgR-mediated effector function, whereas the CH1 and upper portions of the hinge of the antibody can be replaced with IgG2 or modified IgG2 sequences, to potentially combine the effector functions of IgG1 and modified IgG1 with the superior internalization or signaling properties of antibodies containing IgG2 CH1 and/or hinge regions.

Example 27: GITR Agonist Antibody Internalization is Enhanced in Antibodies Having an IgG2 Hinge and CH1 Domain To induce GITR expression, cells were incubated for 72h at 37° C. with 20 ng/ml anti-CD3+1000 ng/ml CD28. As an alternate method of T-cell activation, large batches of activated CD4+ T-cells were prepared by a three stage culture protocol. Briefly, CD4+ T-cells were stimulated with plate bound CD3 (1.5 μg/ml) supplemented with 1 μg/ml soluble CD28 for 72h at 37° C., expanded in culture for 14 days in the presence of 20 u/ml IL-2 and finally exposed to another round of activation by addition of 10 μg/ml PHA, 2 u/ml IL-2 and 1 μg/ml CD28 for 72h at 37° C. Stimulated T cells were seeded into 384 well PDL imaging plates for 2h to adhere the cells, cooled for 15 min at 4° C., and then Alexa 488-labeled GITR antibodies were added separately for 1h. Plates were finally imaged by HCS and the data were reported as total intensity per cell.

Three different GITR antibodies have been evaluated using the above mentioned T cell activation methods. They are GITR.6 antibody as a G1 isotype and an inert (IgG1.1) isotype unable to bind to Fc receptors, as well as a chimera with the IgG2 hinge in place of the IgG1 hinge.

Figure 72:
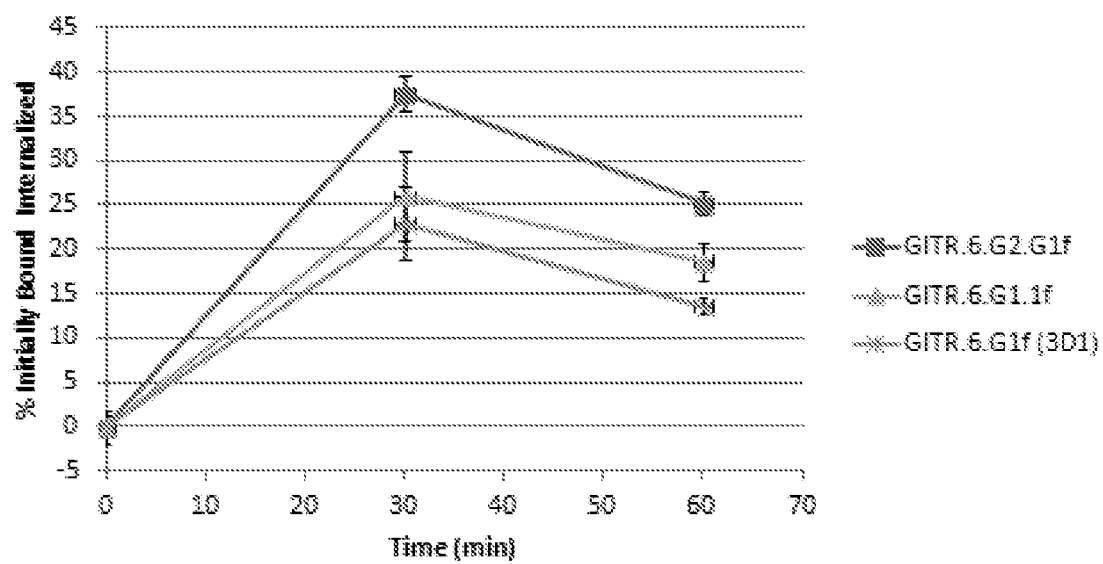
FIG. 72 shows an internalization time course analysis of anti-GITR antibodies.

GITR antibody-induced internalization was assessed in CD3-stimulated CD4+ T-cells using the Alexa quench assay format. Freshly obtained CD4-positive T cells were incubated under conditions as described above to induce GITR expression. After stimulation, cells were resuspended into fresh media and plated for internalization assays as follows. Cells were incubated with antibody as described above, washed with warm media and incubated at 37° C. for the indicated times prior to fixation and quenching. Internalized antibody was measured as increased fluorescence above the small unquenchable signal observed at time zero and then normalized against the total fluorescence "unquenched control" initially bound to the cells. As shown in FIG. 72, GITR ligation resulted in rapid internalization peaking between 30-60 minutes for each antibody tested while control antibodies were found to maintain localization to the plasma membrane. The results indicate that the IgG2 hinge region enhances GITR ligation induced internalization.

To further dissect the detailed mechanisms of internalization and associated dynamics, antibody endocytosis and delivery into early endosome compartments was analyzed. In this experiment, cells were subjected to pulse chase analysis with unlabeled antibodies. Upon fixation, cells were permeabilized and stained for the early endosome marker EEA1 (Cell Signaling Technology), washed and then detected with Alexa fluor-488 conjugated anti-rabbit secondary antibody (EEA1) and Alexa fluor-647 conjugated anti-human antibody (GITR). Plates were imaged on an Opera confocal system with a 60× water immersion objective. The results indicated clear segregation between membrane bound anti-GITR antibody staining and intracellular EEA1 signal. Upon warming the cultures, clustering for some antibodies was detected that appears to co-localize with endosomal proteins. Quantification of endosomal co-localization was performed using HCS Studio Software and the results are plotted as the ratio of colocalized pixel intensity relative to total staining (FIG. 73A-C). The colocalization of GITR antibody and early endosome is most prominent at 30 minutes. At this tested time point, GITR.6.G2.G1f showed a higher fraction colocalized than the GITR.6.G1f antibody. The colocalization results correlate with the observations made using the Alexa quenching method described above and support a model suggesting the G2 hinge has potential advantage over G1 for inducing GITR internalization.

Example 28: GITR Agonist Antibody Signaling in T Cell Receptor Activated CD4+ and CD8+ T Cells is Enhanced in Antibodies Having an IgG2 Hinge and CH1 Domain To further investigate the mechanisms for anti-GITR agonist antibodies, several signaling pathways involved in T cell activation, such as NFkB and P38 signaling pathways, were monitored.

Figure 74A:
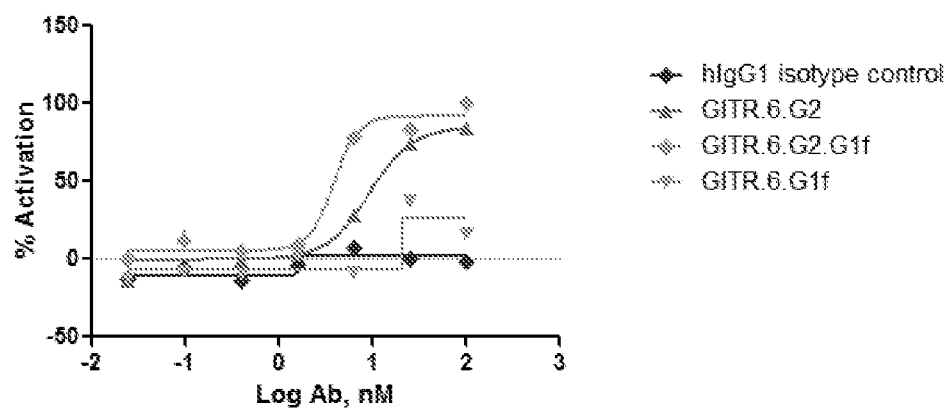
FIG. 74A shows NFkB signaling activation in CD8+ T cells treated with the indicated anti-GITR antibodies.
Figure 74B:
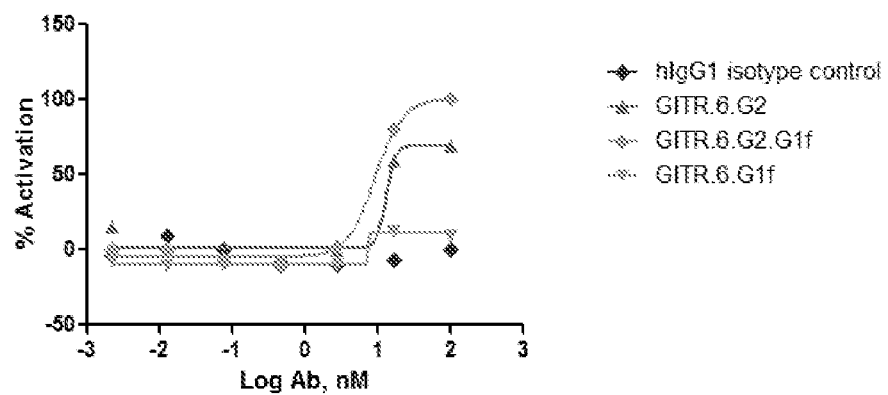
FIG. 74B shows NFkB signaling activation in CD4+ T cells treated with the indicated anti-GITR antibodies.

CD4+ and CD8+ T cells from a healthy donor (M6576) were activated with plate-coated 0.4 μg/ml anti-CD3 and 0.4 μg/ml anti-CD28. After 3 days, cells were collected and plated onto 384-well image plates for signaling activation. After cells settled on the plate for 2 hours, they were treated with anti-GITR antibodies for 15 minutes and the signaling events were terminated by adding formaldehyde to a final of 10% into the assays plate. Cells were then permeabilized and stained with phosphor-p65 NFKB antibody for signaling detection. As shown in FIGS. 74A and 74B, GITR.6.G2 and GITR.6.G2.G1f antibodies had higher signaling responses compared to the GITR.6.G1f in both CD4+ and CD8+ T cells. Although there is no direct evidence of linking internalization and signaling pathway activation, it is intriguing to note that G2 isotype seems to improve both aspects of antibody functional activities compared to the IgG1 for GITR.6.

To quantify the signaling activities for each antibody, both EC50 and Emax for each antibody were calculated, since both parameters are critical to capture the full extent of the signaling event. The response level of GITR.6.G2.G1f is chosen to be the 100% control, and all other antibodies were normalized against it. As shown in Table 14 for both CD4+ and CD8+ T cell populations activated by anti-CD3 and anti-CD28 antibodies, there were a range of activities for GITR antibodies in terms of both potency (EC50s) and efficacy (Emax %). Although GITR.6.G2, GITR.6.G2.G1f and GITR.6.G1f showed similar potencies (EC50s) around 10 nM range, the efficacy (Emax) was quite different for different isotypes, suggesting G1 antibody does not signal as effectively as the G2 or chimeric isotypes.

TABLE 14

Summary of the GITR HuMab NFKB Signaling activities in TCR Activated CD4+ and CD8+ T Cells

| Antibody | CD4+ T cells | | CD8+ T cells | |
|---|---|---|---|---|
| | EC50 (nM) | Emax (%) | EC50 (nM) | Emax (%) |
| GITR.6.G2 | 12.8 | 69 | 9.00 | 85 |
| GITR.6.G2.Gif | 9.00 | 100 | 3.77 | 92 |
| GITR.6.G1f | 7.3 | 10.8 | 20.05 | 27 |
| hIgG1 Isotype Control | Inactive | 4 | Inactive | 6 |

Figure 75:
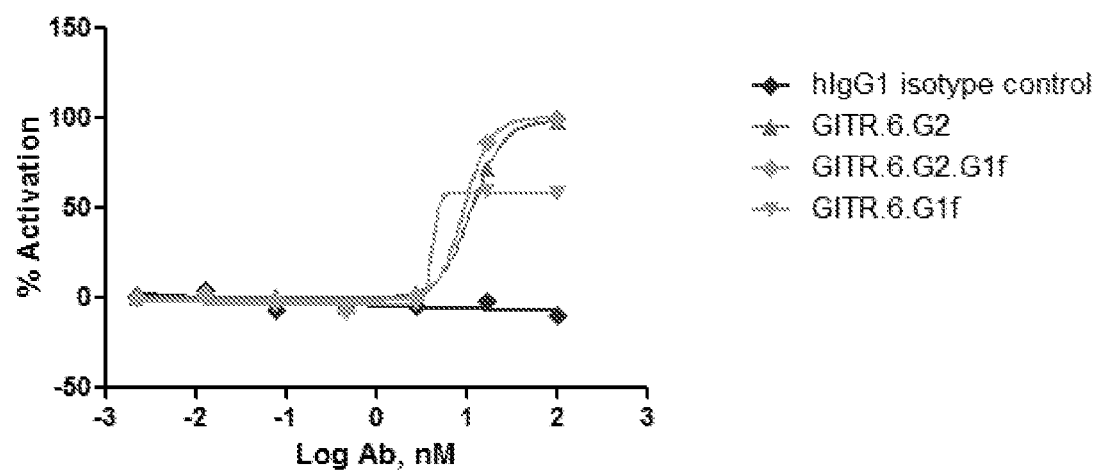
FIG. 75 shows P38 activation in CD4+ T cells treated with the indicated anti-GITR antibodies.
Figure 76A:
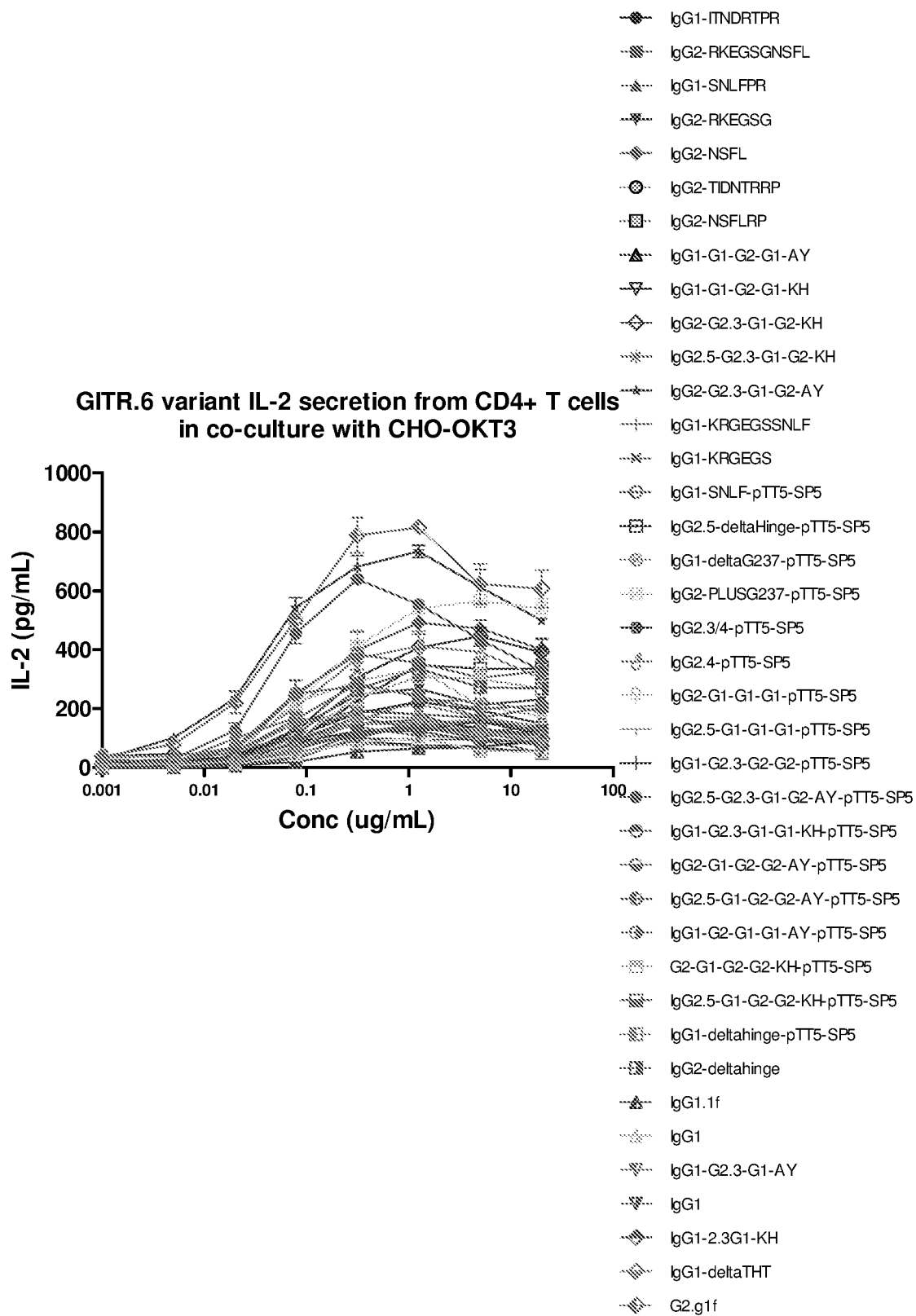
FIG. 76A shows the level of IL-2 secreted by CD4+ T cells co-cocultured with CHO-OKT3 cells in the presence of different concentrations of an anti-GITR antibody having the indicated constant regions.
Figure 76B:
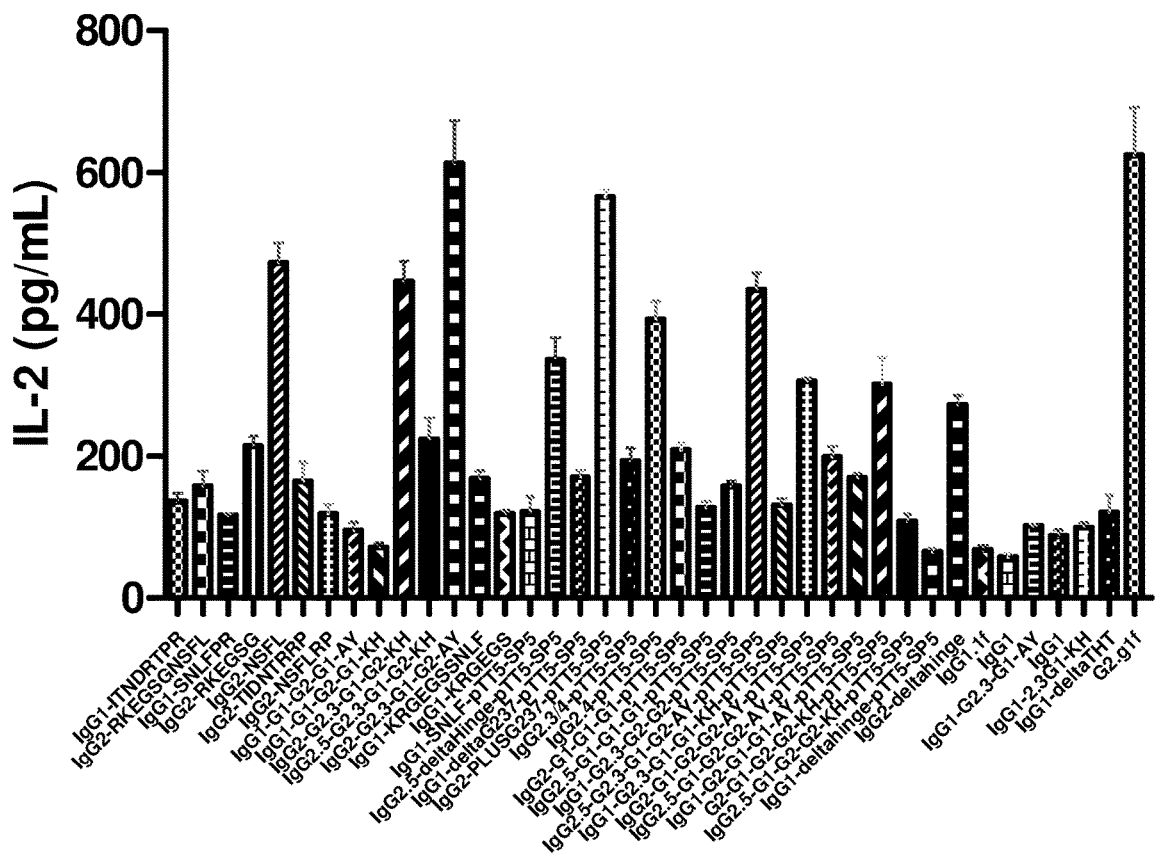
FIG. 76B shows the level of IL-2 secreted by CD4+ T cells co-cocultured with CHO-OKT3 cells in the presence of 5 μg/ml of an anti-GITR antibody having the indicated constant regions (same experiment as that in FIG. 76A).
Figure 76C:
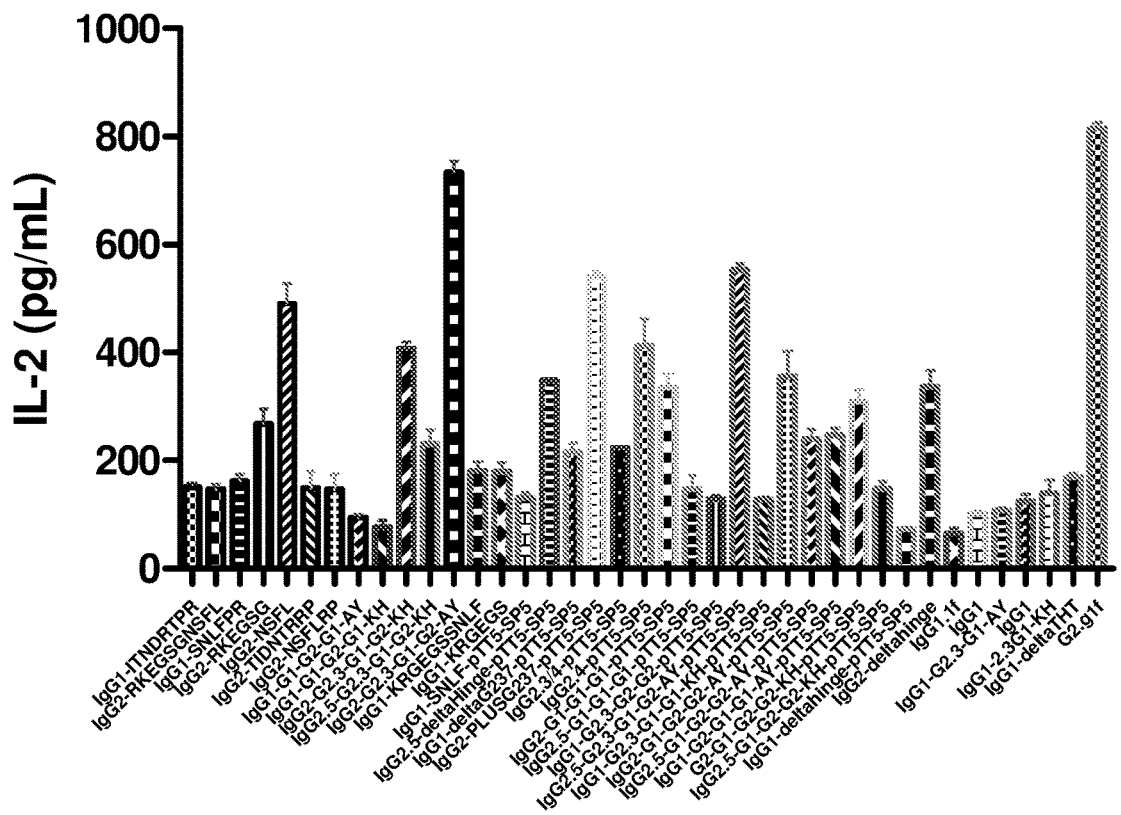
FIG. 76C shows the level of IL-2 secreted by CD4+ T cells co-cocultured with CHO-OKT3 cells in the presence of 1.25 μg/ml of an anti-GITR antibody having the indicated constant regions (same experiment as that in FIG. 76A).
Figure 76D:
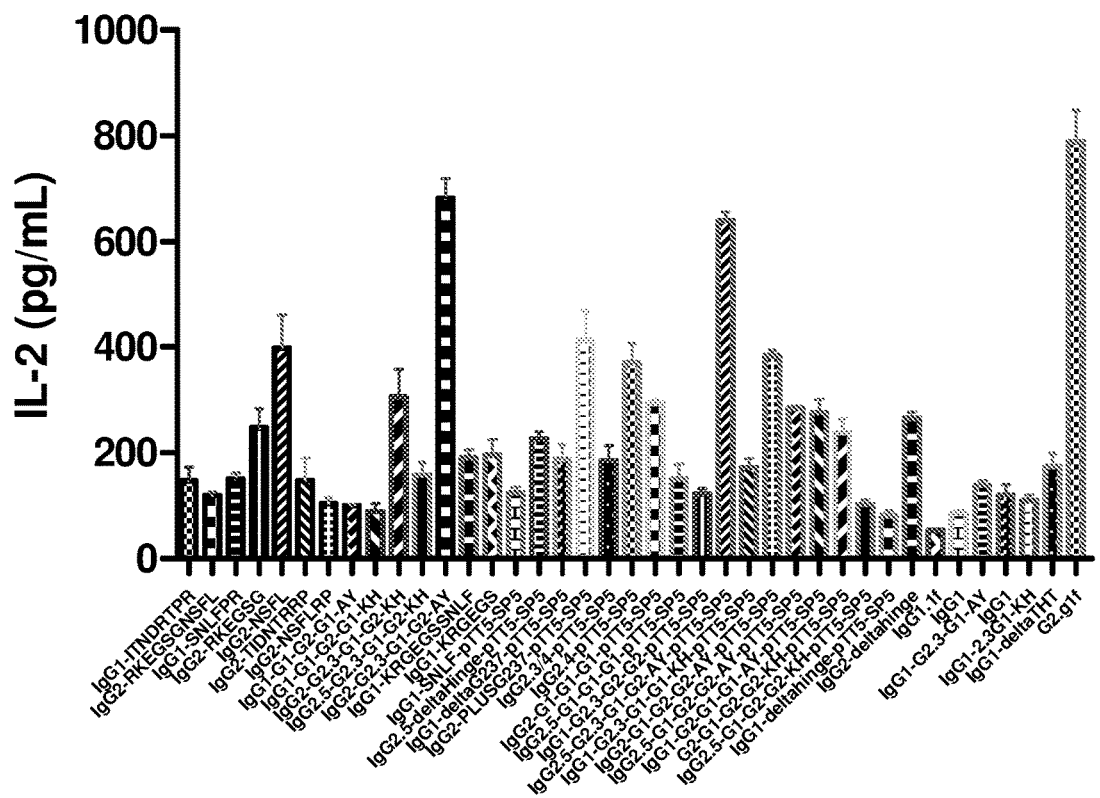
FIG. 76D shows the level of IL-2 secreted by CD4+ T cells co-cocultured with CHO-OKT3 cells in the presence of 0.313 μg/ml of an anti-GITR antibody having the indicated constant regions (same experiment as that in FIG. 76A).

To further confirm if the signaling difference of GITR.6.G2 and GITR.6.G2.G1f compared to GITR.6.G1f is limited to NFkB signaling only or if it holds true for other signaling events as well, a P38MAPK signaling readout was explored. As shown in FIG. 75, GITR.6.G2 and GITR.6.G2.G1f antibodies had higher signaling responses compared to the GITR.6.G1f antibody in a CD4+ cell p38 MAPK activation assay. Therefore, the better signaling activities for GITR.6 G2 isotype compared with G1 isotype is not only limited to NFkB signaling.

Example 29: Relevance of Certain Amino Acid Residues in IgG2 CH1 and Hinge in Improving GITR Agonism on T Cells Anti-GITR antibodies (GITR.6) with the heavy chain constant regions of 28F3 were prepared and tested in IL-2 production assays as described in Example 25, but in which supernatants were harvested at 40 hours rather than 48 hours. The results are shown in FIG. 76A-D.

TABLE 15

SUMMARY OF SEQUENCE LISTING

| SEQ ID | Description | Sequence |
|---|---|---|
| 1 | Human GITR isoform 1 | MAQHGAMGAFRALCGLALLCALSLGQRPTGGPGCGPGRLLLGTGTD ARCCRVHTTRCCRDYPGEECCSEWDCMCVQPEFHCGDPCCTTCRHH PCPPGQGVQSQGKFSFGFQCIDCASGTFSGGHEGHCKPWTDCTQFG FLTVFPGNKTHNAVCVPGSPPAEPLGWLTVVLLAVAACVLLLTSAQ LGLHIWQLRSQCMWPRETQLLLEVPPSTEDARSCQFPEEERGERSA EEKGRLGDLWV |
| 2 | Human GITR isoform 2 | MAQHGAMGAFRALCGLALLCALSLGQRPTGGPGCGPGRLLLGTGTD ARCCRVHTTRCCRDYPGEECCSEWDCMCVQPEFHCGDPCCTTCRHH PCPPGQGVQSQGKFSFGFQCIDCASGTFSGGHEGHCKPWTDCCWRC RRRPKTPEAASSPRKSGASDRQRRRGGWETCGCEPGRPPGPPTAAS PSPGAPQAAGALRSALGRALLPWQQKWVQEGGSDQRPGPCSSAAAA GPCRRERETQSWPPSSLAGPDGVGS |

TABLE 15-continued

SUMMARY OF SEQUENCE LISTING

| SEQ ID | Description | Sequence |
|---|---|---|
| 3 | Human GITR isoform 3 | MAQHGAMGAFRALCGLALLCALSLGQRPTGGPGCGPGRLLLGTGTD ARCCRVHTTRCCRDYPGEECCSEWDCMCVQPEFHCGDPCCTTCRHH PCPPGQVQSQGKFSFGFQCIDCASGTFSGGHEGHCKPWTDCTQFG FLTVFPGNKTHNAVCVPGSPPAEPLGWLTVVLLAVAACVLLLTSAQ LGLHIWQLRKTQLLLEVPPSTEDARSCQFPEEERGERSAEEKGRLG DLWV |
| 4 | Human GITR (mature) | QRPTGGPGCGPGRLLLGTGTDARCCRVHTTRCCRDYPGEECCSEWD CMCVQPEFHCGDPCCTTCRHHPCPPGQVQSQGKFSFGFQCIDCAS GTFSGGHEGHCKPWTDCTQFGFLTVFPGNKTHNAVCVPGSPPAEP |
| 5 | Cynomolgus GITR | MCASGTLCCLALLCAASLGQRPTGGPGCGPGRLLLGTGKDARCCRV HPTRCCRDYQGEECCSEWDCVCVQPEFHCGNPCCTTCQHHPCPSGQ GVQPQGKFSFGFRCVDCALGTFSRGHDGHCKPWTDCTQFGFLTVFP GNKTHNAVCVPGSPPAEPPGWLTIILLAVAACVLLLTSAQLGLHIW QLRSQPTGPRETQLLLEVPPSTEDASSCQFPEEERGERLAEEKGRL GDLWV |
| 6 | Human GITR-L | MTLHPSPITCEFLFSTALISPKMCLSHLENMPLSHSRTQGAQRSSW KLWLFCSIVMLLFLCSFSWLIFIFLQLETAKEPCMAKFGPLPSKWQ MASSEPPCVNKVSDWKLEILQNGLYLIYGQVAPNANYNDVAPFEVR LYKNKDMIQTLTNKSKIQNVGGTYELHVGDTIDLIFNSEHQVLKNN TYWGIILLANPQFIS |
| 7 | Human IgG1 constant domain | ASTKGPSVFPLAPSSKSTSGGTAALGCLVKDYFPEPVTVSWNSGAL TSGVHTFPAVLQSSGLYSLSSVVTVPSSSLGTQTYICNVNHKPSNT KVDKRVEPKSCDKTHTCPPCPAPELLGGPSVFLFPPKPKDTLMISR TPEVTCVVVDVSHEDPEVKFNWYVDGVEVHNAKTKPREEQYNSTYR VVSVLTVLHQDWLNGKEYKCKVSNKALPAPIEKTISKAKGQPREPQ VYTLPPSREEMTKNQVSLTCLVKGFYPSDIAVEWESNGQPENNYKT TPPVLDSDGSFFLYSKLTVDKSRWQQGNVFSCSVMHEALHNHYTQK SLSLSPG |
| 8 | Human IgG1 constant domain (allotypic variant) | ASTKGPSVFPLAPSSKSTSGGTAALGCLVKDYFPEPVTVSWNSGAL TSGVHTFPAVLQSSGLYSLSSVVTVPSSSLGTQTYICNVNHKPSNT KVDKKVEPKSCDKTHTCPPCPAPELLGGPSVFLFPPKPKDTLMISR TPEVTCVVVDVSHEDPEVKFNWYVDGVEVHNAKTKPREEQYNSTYR VVSVLTVLHQDWLNGKEYKCKVSNKALPAPIEKTISKAKGQPREPQ VYTLPPSRDELTKNQVSLTCLVKGFYPSDIAVEWESNGQPENNYKT TPPVLDSDGSFFLYSKLTVDKSRWQQGNVFSCSVMHEALHNHYTQK SLSLSPG |
| 9 | Human IgG1constant domain with L234A, L235E, and G237A mutations | ASTKGPSVFPLAPSSKSTSGGTAALGCLVKDYFPEPVTVSWNSGAL TSGVHTFPAVLQSSGLYSLSSVVTVPSSSLGTQTYICNVNHKPSNT KVDKRVEPKSCDKTHTCPPCPAPEAEGAPSVFLF PPKPKDTLMISRTPEVTCVVVDVSHEDPEVKFNWYVDGVE VHNAKTKPREEQYNSTYRVVSVLTVLHQDWLNGKEYKCKV SNKALPAPIEKTISKAKGQPREPQVYTLPPSREEMTKNQVSLTCLV KGFYPSDIAVEWESNGQPENNYKTTPPVLDSDGSFFLYSKLTVDKS RWQQGNVFSCSVMHEALHNHYTQKSLSLSPG |
| 10 | Human IgG1constant domain with A330S and P331S mutations | ASTKGPSVFPLAPSSKSTSGGTAALGCLVKDYFPEPVTVSWNSGAL TSGVHTFPAVLQSSGLYSLSSVVTVPSSSLGTQTYICNVNHKPSNT KVDKRVEPKSCDKTHTCPPCPAPELLGGPSVFLF PPKPKDTLMISRTPEVTCVVVDVSHEDPEVKFNWYVDGVE VHNAKTKPREEQYNSTYRVVSVLTVLHQDWLNGKEYKCKV SNKALPSSIEKTISKAKGQPREPQVYTLPPSREEMTKNQVSLTCLV KGFYPSDIAVEWESNGQPENNYKTTPPVLDSDGSFFLYSKLTVDKS RWQQGNVFSCSVMHEALHNHYTQKSLSLSPG |
| 11 | Human IgG1.1 constant domain (L234A, L235E, G237A, A330S, and P331S mutations) | ASTKGPSVFPLAPSSKSTSGGTAALGCLVKDYFPEPVTVSWNSGAL TSGVHTFPAVLQSSGLYSLSSVVTVPSSSLGTQTYICNVNHKPSNT KVDKRVEPKSCDKTHTCPPCPAPEAEGAPSVFLFPPKPKDTLMISR TPEVTCVVVDVSHEDPEVKFNWYVDGVEVHNAKTKPREEQYNSTYR VVSVLTVLHQDWLNGKEYKCKVSNKALPSSIEKTISKAKGQPREPQ VYTLPPSREEMTKNQVSLTCLVKGFYPSDIAVEWESNGQPENNYKT TPPVLDSDGSFFLYSKLTVDKSRWQQGNVFSCSVMHEALHNHYTQK SLSLSPG |
| 12 | Human IgG1 kappa light chain constant region (CL) | RTVAAPSVFIFPPSDEQLKSGTASVVCLLNNFYPREAKVQWKVDNA LQSGNSQESVTEQDSKDSTYSLSSTLTLSKADYEKHKVYACEVTHQ GLSSPVTKSFNRGEC |

TABLE 15-continued

SUMMARY OF SEQUENCE LISTING

| SEQ ID | Description | Sequence |
|---|---|---|
| 13 | 28F3 (VH) | QVQLVESGGGVVQPGRSLRLSCAASGFTFSSYGMHWVRQAPGKGLEWVAVIWYEGSNKYYADSVKGRFTISRDNSKNTLYLQMNSLRAEDTAVYYCARGGSMVRGDYYYGMDVWGQGTTVTVSS |
| 14 | 28F3 (VL) | AIQLTQSPSSLSASVGDRVTITCRASQGISSALAWYQQKPGKAPKLLIYDASSLESGVPSRFSGSGSGTDFTLTISSLQPEDFATYYCQQFNSYPYTFGQGTKLEIK |
| 15 | 28F3 (full length wild-type heavy chain) The constant region is underlined | QVQLVESGGGVVQPGRSLRLSCAASGFTFSSYGMHWVRQAPGKGLEWVAVIWYEGSNKYYADSVKGRFTISRDNSKNTLYLQMNSLRAEDTAVYYCARGGSMVRGDYYYGMDVWGQGTTVTVSS<u>ASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK</u> |
| 16 | 28F3 (full length wild-type light chain) The constant region is underlined | AIQLTQSPSSLSASVGDRVTITCRASQGISSALAWYQQKPGKAPKLLIYDASSLESGVPSRFSGSGSGTDFTLTISSLQPEDFATYYCQQFNSYPYTFGQGTKLEIK<u>RTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC</u> |
| 17 | 28F3.IgG1 (VH + IgG1) | QVQLVESGGGVVQPGRSLRLSCAASGFTFSSYGMHWVRQAPGKGLEWVAVIWYEGSNKYYADSVKGRFTISRDNSKNTLYLQMNSLRAEDTAVYYCARGGSMVRGDYYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG |
| 18 | 28F3.IgG1.1 (VH + IgG1.1) | QVQLVESGGGVVQPGRSLRLSCAASGFTFSSYGMHWVRQAPGKGLEWVAVIWYEGSNKYYADSVKGRFTISRDNSKNTLYLQMNSLRAEDTAVYYCARGGSMVRGDYYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPSSIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG |
| 19 | 28F3.IgG1 (VL + CL) | AIQLTQSPSSLSASVGDRVTITCRASQGISSALAWYQQKPGKAPKLLIYDASSLESGVPSRFSGSGSGTDFTLTISSLQPEDFATYYCQQFNSYPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC |
| 20 | 28F3 VH CDR1 | SYGMH |
| 21 | 28F3 VH CDR2 | VIWYEGSNKYYADSVKG |
| 22 | 28F3 VH CDR3 | GGSMVRGDYYYGMDV |
| 23 | 28F3 VL CDR1 | RASQGISSALA |
| 24 | 28F3 VL CDR2 | DASSLES |
| 25 | 28F3 VL CDR3 | QQFNSYPYT |
| 26 | 19D3 (VH) | QVQLVESGGGVVQPGRSLRLSCAASGFTFSSYGFHWVRQAPGKGLEWVAVIWYAGSNKFYADSVKGRFTISRDNSKNTLYLQMNSLRAEDTAVYYCARGGQLDYYYYYVMDVWGQGTTVTVSS |
| 27 | 19D3 (VL) | DIQMTQSPSSLSASVGDRVTITCRASQGISSWLAWYQQKPEKAPKSLIYAASSLQSGVPSRFSGSGSGTDFTLTISSLQPEDFATYYCQQYNSYPYTFGQGTKLEIK |

TABLE 15-continued

SUMMARY OF SEQUENCE LISTING

| SEQ ID | Description | Sequence |
|---|---|---|
| 28 | 19D3 (full length wild-type heavy chain) The constant region is underlined | QVQLVESGGGVVQPGRSLRLSCAASGFTFSSYGFHWVRQAPGKGLE WVAVIWYAGSNKFYADSVKGRFTISRDNSKNTLYLQMNSLRAEDTA VYYCARGGQLDYYYYYVMDVWGQGTTVTVSS<u>ASTKGPSVFPLAPCS RSTSESTAALGCLVKDYFPEPVTVSWNSGALTSGVHTFPAVLQSSG LYSLSSVVTVPSSNFGTQTYTCNVDHKPSNTKVDKTVERKCCVECP PCPAPPVAGPSVFLFPPKPKDTLMISRTPEVTCVVVDVSHEDPEVQ FNWYVDGVEVHNAKTKPREEQFNSTFRVVSVLTVVHQDWLNGKEYK CKVSNKGLPAPIEKTISKTKGQPREPQVYTLPPSREEMTKNQVSLT CLVKGFYPSDIAVEWESNGQPENNYKTTPPMLDSDGSFFLYSKLTV DKSRWQQGNVFSCSVMHEALHNHYTQKSLSLSPGK</u> |
| 29 | 19D3 (full length wild-type light chain) The constant region is underlined | DIQMTQSPSSLSASVGDRVTITCRASQGISSWLAWYQQKPEKAPKS LIYAASSLQSGVPSRFSGSGSGTDFTLTISSLQPEDFATYYCQQYN SYPYTFGQGTKLEIK<u>RTVAAPSVFIFPPSDEQLKSGTASVVCLLNN FYPREAKVQWKVDNALQSGNSQESVTEQDSKDSTYSLSSTLTLSKA DYEKHKVYACEVTHQGLSSPVTKSFNRGEC</u> |
| 30 | 19D3.IgG1 (VH + IgG1) | QVQLVESGGGVVQPGRSLRLSCAASGFTFSSYGFHWVRQAPGKGLE WVAVIWYAGSNKFYADSVKGRFTISRDNSKNTLYLQMNSLRAEDTA VYYCARGGQLDYYYYYVMDVWGQGTTVTVSSASTKGPSVFPLAPSS KSTSGGTAALGCLVKDYFPEPVTVSWNSGALTSGVHTFPAVLQSSG LYSLSSVVTVPSSSLGTQTYICNVNHKPSNTKVDKRVEPKSCDKTH TCPPCPAPELLGGPSVFLFPPKPKDTLMISRTPEVTCVVVDVSHED PEVKFNWYVDGVEVHNAKTKPREEQYNSTYRVVSVLTVLHQDWLNG KEYKCKVSNKALPAPIEKTISKAKGQPREPQVYTLPPSREEMTKNQ VSLTCLVKGFYPSDIAVEWESNGQPENNYKTTPPVLDSDGSFFLYS KLTVDKSRWQQGNVFSCSVMHEALHNHYTQKSLSLSPG |
| 31 | 19D3.IgG1.1 (VH + IgG1.1) | QVQLVESGGGVVQPGRSLRLSCAASGFTFSSYGFHWVRQAPGKGLE WVAVIWYAGSNKFYADSVKGRFTISRDNSKNTLYLQMNSLRAEDTA VYYCARGGQLDYYYYYVMDVWGQGTTVTVSSASTKGPSVFPLAPSS KSTSGGTAALGCLVKDYFPEPVTVSWNSGALTSGVHTFPAVLQSSG LYSLSSVVTVPSSSLGTQTYICNVNHKPSNTKVDKRVEPKSCDKTH TCPPCPAPE<u>AEGA</u>PSVFLFPPKPKDTLMISRTPEVTCVVVDVSHED PEVKFNWYVDGVEVHNAKTKPREEQYNSTYRVVSVLTVLHQDWLNG KEYKCKVSNKALP<u>SS</u>IEKTISKAKGQPREPQVYTLPPSREEMTKNQ VSLTCLVKGFYPSDIAVEWESNGQPENNYKTTPPVLDSDGSFFLYS KLTVDKSRWQQGNVFSCSVMHEALHNHYTQKSLSLSPG |
| 32 | 19D3.IgG1 (VL + CL) | DIQMTQSPSSLSASVGDRVTITCRASQGISSWLAWYQQKPEKAPKS LIYAASSLQSGVPSRFSGSGSGTDFTLTISSLQPEDFATYYCQQYN SYPYTFGQGTKLEIKRTVAAPSVFIFPPSDEQLKSGTASVVCLLNN FYPREAKVQWKVDNALQSGNSQESVTEQDSKDSTYSLSSTLTLSKA DYEKHKVYACEVTHQGLSSPVTKSFNRGEC |
| 33 | 19D3 VH CDR1 | SYGFH |
| 34 | 19D3 VH CDR2 | VIWYAGSNKFYADSVKG |
| 35 | 19D3 VH CDR3 | GGQLDYYYYYVMDV |
| 36 | 19D3 VL CDR1 | RASQGISSWLA |
| 37 | 19D3 VL CDR2 | AASSLQS |
| 38 | 19D3 VL CDR3 | QQYNSYPYT |
| 39 | 18E10 (VH) | QVQLVESGGGVVQPGRSLRLSCAASGFTFSSYGMHWVRQAPGKGLE WVAVIWYAGSNKYYADSVKGRFTISRDNSKNTLYLQMNSLRAEDTA VYYCARGGRIAVAFYYSMDVWGQGTTVTVSS |
| 40 | 18E10 (VL) | DIQMTQSPSSLSASVGDRVTITCRASQGISSWLAWYQQKPEKAPKS LIYAASSLQSGVPSRFSGSGSGTDFTLTISSLQPEDFATYYCQQYN SYPYTFGQGTKLEIK |
| 41 | 18E10 (full length wild-type heavy chain) The constant region is underlined | QVQLVESGGGVVQPGRSLRLSCAASGFTFSSYGMHWVRQAPGKGLE WVAVIWYAGSNKYYADSVKGRFTISRDNSKNTLYLQMNSLRAEDTA VYYCARGGRIAVAFYYSMDVWGQGTTVTVSS<u>ASTKGPSVFPLAPCS RSTSESTAALGCLVKDYFPEPVTVSWNSGALTSGVHTFPAVLQSSG LYSLSSVVTVPSSNFGTQTYTCNVDHKPSNTKVDKTVERKCCVECP PCPAPPVAGPSVFLFPPKPKDTLMISRTPEVTCVVVDVSHEDPEVQ FNWYVDGVEVHNAKTKPREEQFNSTFRVVSVLTVVHQDWLNGKEYK CKVSNKGLPAPIEKTISKTKGQPREPQVYTLPPSREEMTKNQVSLT CLVKGFYPSDIAVEWESNGQPENNYKTTPPMLDSDGSFFLYSKLTV DKSRWQQGNVFSCSVMHEALHNHYTQKSLSLSPGK</u> |

TABLE 15-continued

SUMMARY OF SEQUENCE LISTING

| SEQ ID | Description | Sequence |
|---|---|---|
| 42 | 18E10 (full length wild-type light chain) The constant region is underlined | DIQMTQSPSSLSASVGDRVTITCRASQGISSWLAWYQQKPEKAPKS LIYAASSLQSGVPSRFSGSGSGTDFTLTISSLQPEDFATYYCQQYN SYPYTFGQGTKLEIKRTVAAPSVFIFPPSDEQLKSGTASVVCLLNN FYPREAKVQWKVDNALQSGNSQESVTEQDSKDSTYSLSSTLTLSKA DYEKHKVYACEVTHQGLSSPVTKSFNRGEC |
| 43 | 18E10.IgG1 (VH + IgG1) | QVQLVESGGGVVQPGRSLRLSCAASGFTFSSYGMHWVRQAPGKGLE WVAVIWYAGSNKYYADSVKGRFTISRDNSKNTLYLQMNSLRAEDTA VYYCARGGRIAVAFYYSMDVWGQGTTVTVSSASTKGPSVFPLAPSS KSTSGGTAALGCLVKDYFPEPVTVSWNSGALTSGVHTFPAVLQSSG LYSLSSVVTVPSSSLGTQTYICNVNHKPSNTKVDKRVEPKSCDKTH TCPPCPAPELLGGPSVFLF PPKPKDTLMISRTPEVTCVVVDVSHEDPEVKFNWYVDGVE VHNAKTKPREEQYNSTYRVVSVLTVLHQDWLNGKEYKCKV SNKALPAPIEKTISKAKGQPREPQVYTLPPSREEMTKNQVSLTCLV KGFYPSDIAVEWESNGQPENNYKTTPPVLDSDGSFFLYSKLTVDKS RWQQGNVFSCSVMHEALHNHYTQKSLSLSPG |
| 44 | 18E10.IgG1.1 (VH + IgG1.1) | QVQLVESGGGVVQPGRSLRLSCAASGFTFSSYGMHWVRQAPGKGLE WVAVIWYAGSNKYYADSVKGRFTISRDNSKNTLYLQMNSLRAEDTA VYYCARGGRIAVAFYYSMDVWGQGTTVTVSSASTKGPSVFPLAPSS KSTSGGTAALGCLVKDYFPEPVTVSWNSGALTSGVHTFPAVLQSSG LYSLSSVVTVPSSSLGTQTYICNVNHKPSNTKVDKRVEPKSCDKTH TCPPCPAPEAEGAPSVFLFPPKPKDTLMISRTPEVTCVVVDVSHED PEVKFNWYVDGVEVHNAKTKPREEQYNSTYRVVSVLTVLHQDWLNG KEYKCKVSNKALPSSIEKTISKAKGQPREPQVYTLPPSREEMTKNQ VSLTCLVKGFYPSDIAVEWESNGQPENNYKTTPPVLDSDGSFFLYS KLTVDKSRWQQGNVFSCSVMHEALHNHYTQKSLSLSPG |
| 45 | 18E10.IgG1 (VL + CL) | DIQMTQSPSSLSASVGDRVTITCRASQGISSWLAWYQQKPEKAPKS LIYAASSLQSGVPSRFSGSGSGTDFTLTISSLQPEDFATYYCQQYN SYPYTFGQGTKLEIKRTVAAPSVFIFPPSDEQLKSGTASVVCLLNN FYPREAKVQWKVDNALQSGNSQESVTEQDSKDSTYSLSSTLTLSKA DYEKHKVYACEVTHQGLSSPVTKSFNRGEC |
| 46 | 18E10 VH CDR1 | SYGMH |
| 47 | 18E10 VH CDR2 | VIWYAGSNKYYADSVKG |
| 48 | 18E10 VH CDR3 | GGRIAVAFYYSMDV |
| 49 | 18E10 VL CDR1 | RASQGISSWLA |
| 50 | 18E10 VL CDR2 | AASSLQS |
| 51 | 18E10 VL CDR3 | QQYNSYPYT |
| 52 | 3C3 (VH) | QVQLQQWGAGLLKPSETLSLTCAVYGGSFSGYYWTWIRQPPGKGLE WIGKINHSGNTNYNPSLKSRVTISVDTSKNQFSLKLSSVTAADTAV YYCARLGAFDAFDIWGQGTMVTVSS |
| 53 | 3C3 (VL1) | DIQMTQSPSSLSASVGDRVTITCRASQGISSWLAWYQQKPEKAPKS LIYAASSLQSGVPSRFSGSGSGTDFTLTISSLQPEDFATYYCQQYN SYPYTFGQGTKLEIK |
| 54 | 3C3 (VL2) | EIVLTQSPATLSLSPGERATLSCRASQGVSSYLAWYQQKPGQAPRL LIYDASNRATGIPARFSGSGPGTDFTLTISSLEPEDFAVYYCQQRS NWHTFGQGTKLEIK |
| 55 | 3C3 (full length wild-type heavy chain) The constant region is underlined | QVQLQQWGAGLLKPSETLSLTCAVYGGSFSGYYWTWIRQPPGKGLE WIGKINHSGNTNYNPSLKSRVTISVDTSKNQFSLKLSSVTAADTAV YYCARLGAFDAFDIWGQGTMVTVSSASTKGPSVFPLAPSSKSTSGG TAALGCLVKDYFPEPVTVSWNSGALTSGVHTFPAVLQSSGLYSLSS VVTVPSSSLGTQTYICNVNHKPSNTKVDKRVEPKSCDKTHTCPPCP APELLGGPSVFLFPPKPKDTLMISRTPEVTCVVVDVSHEDPEVKFN WYVDGVEVHNAKTKPREEQYNSTYRVVSVLTVLHQDWLNGKEYKCK VSNKALPAPIEKTISKAKGQPREPQVYTLPPSRDELTKNQVSLTCL VKGFYPSDIAVEWESNGQPENNYKTTPPVLDSDGSFFLYSKLTVDK SRWQQGNVFSCSVMHEALHNHYTQKSLSLSPGK |

TABLE 15-continued

SUMMARY OF SEQUENCE LISTING

| SEQ ID | Description | Sequence |
|---|---|---|
| 56 | 3C3 L1 (full length wild-type light chain 1) The constant region is underlined | DIQMTQSPSSLSASVGDRVTITCRASQGISSWLAWYQQKPEKAPKS LIYAASSLQSGVPSRFSGSGSGTDFTLTISSLQPEDFATYYCQQYN SYPYTFGQGTKLEIKRTVAAPSVFIFPPSDEQLKSGTASVVCLLNN FYPREAKVQWKVDNALQSGNSQESVTEQDSKDSTYSLSSTLTLSKA DYEKHKVYACEVTHQGLSSPVTKSFNRGEC |
| 57 | 3C3 L2 (full length wild-type light chain 2) The constant region is underlined | EIVLTQSPATLSLSPGERATLSCRASQGVSSYLAWYQQKPGQAPRL LIYDASNRATGIPARFSGSGPGTDFTLTISSLEPEDFAVYYCQQRS NWHTFGQGTKLEIKRTVAAPSVFIFPPSDEQLKSGTASVVCLLNNF YPREAKVQWKVDNALQSGNSQESVTEQDSKDSTYSLSSTLTLSKAD YEKHKVYACEVTHQGLSSPVTKSFNRGEC |
| 58 | 3C3.IgG1 (VH + IgG1) | QVQLQQWGAGLLKPSETLSLTCAVYGGSFSGYYWTWIRQPPGKGLE WIGKINHSGNTNYNPSLKSRVTISVDTSKNQFSLKLSSVTAADTAV YYCARLGAFDAFDIWGQGTMVTVSSASTKGPSVFPLAPSSKSTSGG TAALGCLVKDYFPEPVTVSWNSGALTSGVHTFPAVLQSSGLYSLSS VVTVPSSSLGTQTYICNVNHKPSNTKVDKRVEPKSCDKTHTCPPCP APELLGGPSVFLF PPKPKDTLMISRTPEVTCVVVDVSHEDPEVKFNWYVDGVE VHNAKTKPREEQYNSTYRVVSVLTVLHQDWLNGKEYKCKV SNKALPAPIEKTISKAKGQPREPQVYTLPPSREEMTKNQVSLTCLV KGFYPSDIAVEWESNGQPENNYKTTPPVLDSDGSFFLYSKLTVDKS RWQQGNVFSCSVMHEALHNHYTQKSLSLSPG |
| 59 | 3C3.IgG1.1 (VH + IgG1.1) | QVQLQQWGAGLLKPSETLSLTCAVYGGSFSGYYWTWIRQPPGKGLE WIGKINHSGNTNYNPSLKSRVTISVDTSKNQFSLKLSSVTAADTAV YYCARLGAFDAFDIWGQGTMVTVSSASTKGPSVFPLAPSSKSTSGG TAALGCLVKDYFPEPVTVSWNSGALTSGVHTFPAVLQSSGLYSLSS VVTVPSSSLGTQTYICNVNHKPSNTKVDKRVEPKSCDKTHTCPPCP APEAEGAPSVFLFPPKPKDTLMISRTPEVTCVVVDVSHEDPEVKFN WYVDGVEVHNAKTKPREEQYNSTYRVVSVLTVLHQDWLNGKEYKCK VSNKALPSSIEKTISKAKGQPREPQVYTLPPSREEMTKNQVSLTCL VKGFYPSDIAVEWESNGQPENNYKTTPPVLDSDGSFFLYSKLTVDK SRWQQGNVFSCSVMHEALHNHYTQKSLSLSPG |
| 60 | 3C3.IgG1 (VL1 + CL) | DIQMTQSPSSLSASVGDRVTITCRASQGISSWLAWYQQKPEKAPKS LIYAASSLQSGVPSRFSGSGSGTDFTLTISSLQPEDFATYYCQQYN SYPYTFGQGTKLEIKRTVAAPSVFIFPPSDEQLKSGTASVVCLLNN FYPREAKVQWKVDNALQSGNSQESVTEQDSKDSTYSLSSTLTLSKA DYEKHKVYACEVTHQGLSSPVTKSFNRGEC |
| 61 | 3C3IgG1.2 (VL2 + CL) | EIVLTQSPATLSLSPGERATLSCRASQGVSSYLAWYQQKPGQAPRL LIYDASNRATGIPARFSGSGPGTDFTLTISSLEPEDFAVYYCQQRS NWHTFGQGTKLEIKRTVAAPSVFIFPPSDEQLKSGTASVVCLLNNF YPREAKVQWKVDNALQSGNSQESVTEQDSKDSTYSLSSTLTLSKAD YEKHKVYACEVTHQGLSSPVTKSFNRGEC |
| 62 | 3C3 VH CDR1 | GYYWT |
| 63 | 3C3 VH CDR2 | KINHSGNTNYNPSLKS |
| 64 | 3C3 VH CDR3 | LGAFDAFDI |
| 65 | 3C3 VL1 CDR1 | RASQGISSWLA |
| 66 | 3C3 VL1 CDR2 | AASSLQS |
| 67 | 3C3 VL1 CDR3 | QQYNSYPYT |
| 68 | 3C3 VL2 CDR1 | RASQGVSSYLA |
| 69 | 3C3 VL2 CDR2 | DASNRAT |
| 70 | 3C3 VL2 CDR3 | QQRSNWHT |
| 71 | 2G6 (VH) | QVQLVESGGGVVQPGGSLRLSCAASGFILSDYGMHWVRQAPGKGLE WVTVIWYDGSNKFYVDSVKGRFTISRDNSKNTLYLQMNSLRVEDTA VYYCARGGRLATGHFYYVMDVWGQGTTVTVSS |
| 72 | 2G6 (VL) | DIQMTQSPSSLSASVGDRVTITCRASQGISSWLAWYQQKPEKAPKS LIYAASSLQSGVPSRFSGSGSGTDFTLTISSLQPEDFATYYCQQYN SYPYTFGQGTKLEIK |

TABLE 15-continued

SUMMARY OF SEQUENCE LISTING

| SEQ ID | Description | Sequence |
|---|---|---|
| 73 | 2G6 (full length wild-type heavy chain) The constant region is underlined | QVQLVESGGGVVQPGGSLRLSCAASGFILSDYGMHWVRQAPGKGLE WVTVIWYDGSNKFYVDSVKGRFTISRDNSKNTLYLQMNSLRVEDTA VYYCARGGRLATGHFYYVMDVWGQGTTVTVSS<u>ASTKGPSVFPLAPC SRSTSESTAALGCLVKDYFPEPVTVSWNSGALTSGVHTFPAVLQSS GLYSLSSVVTVPSSNFGTQTYTCNVDHKPSNTKVDKTVERKCCVEC PPCPAPPVAGPSVFLFPPKPKDTLMISRTPEVTCVVVDVSHEDPEV QFNWYVDGVEVHNAKTKPREEQFNSTFRVVSVLTVVHQDWLNGKEY KCKVSNKGLPAPIEKTISKTKGQPREPQVYTLPPSREEMTKNQVSL TCLVKGFYPSDIAVEWESNGQPENNYKTTPPMLDSDGSFFLYSKLT VDKSRWQQGNVFSCSVMHEALHNHYTQKSLSLSPGK</u> |
| 74 | 2G6 (full length wild-type light chain) The constant region is underlined | DIQMTQSPSSLSASVGDRVTITCRASQGISSWLAWYQQKPEKAPKS LIYAASSLQSGVPSRFSGSGSGTDFTLTISSLQPEDFATYYCQQYN SYPYTFGQGTKLEIK<u>RTVAAPSVFIFPPSDEQLKSGTASVVCLLNN FYPREAKVQWKVDNALQSGNSQESVTEQDSKDSTYSLSSTLTLSKA DYEKHKVYACEVTHQGLSSPVTKSFNRGEC</u> |
| 75 | 2G6.IgG1 (VH + IgG1) | QVQLVESGGGVVQPGGSLRLSCAASGFILSDYGMHWVRQAPGKGLE WVTVIWYDGSNKFYVDSVKGRFTISRDNSKNTLYLQMNSLRVEDTA VYYCARGGRLATGHFYYVMDVWGQGTTVTVSSASTKGPSVFPLAPS SKSTSGGTAALGCLVKDYFPEPVTVSWNSGALTSGVHTFPAVLQSS GLYSLSSVVTVPSSSLGTQTYICNVNHKPSNTKVDKRVEPKSCDKT HTCPPCPAPELLGGPSVFLF PPKPKDTLMISRTPEVTCVVVDVSHEDPEVKFNWYVDGVE VHNAKTKPREEQYNSTYRVVSVLTVLHQDWLNGKEYKCKV SNKALPAPIEKTISKAKGQPREPQVYTLPPSREEMTKNQVSLTCLV KGFYPSDIAVEWESNGQPENNYKTTPPVLDSDGSFFLYSKLTVDKS RWQQGNVFSCSVMHEALHNHYTQKSLSLSPG |
| 76 | 2G6.IgG1.1 (VH + IgG1.1) | QVQLVESGGGVVQPGGSLRLSCAASGFILSDYGMHWVRQAPGKGLE WVTVIWYDGSNKFYVDSVKGRFTISRDNSKNTLYLQMNSLRVEDTA VYYCARGGRLATGHFYYVMDVWGQGTTVTVSSASTKGPSVFPLAPS SKSTSGGTAALGCLVKDYFPEPVTVSWNSGALTSGVHTFPAVLQSS GLYSLSSVVTVPSSSLGTQTYICNVNHKPSNTKVDKRVEPKSCDKT HTCPPCPAPE<u>AEGA</u>PSVFLFPPKPKDTLMISRTPEVTCVVVDVSHE DPFVKFNWYVDGVEVHNAKTKPREEQYNSTYRVVSVLTVLHQDWLN GKEYKCKVSNKALP<u>SS</u>IEKTISKAKGQPREPQVYTLPPSREEMTKN QVSLTCLVKGFYPSDIAVEWESNGQPENNYKTTPPVLDSDGSFFLY SKLTVDKSRWQQGNVFSCSVMHEALHNHYTQKSLSLSPG |
| 77 | 2G6.IgG1 (VL + CL) | DIQMTQSPSSLSASVGDRVTITCRASQGISSWLAWYQQKPEKAPKS LIYAASSLQSGVPSRFSGSGSGTDFTLTISSLQPEDFATYYCQQYN SYPYTFGQGTKLEIKRTVAAPSVFIFPPSDEQLKSGTASVVCLLNN FYPREAKVQWKVDNALQSGNSQESVTEQDSKDSTYSLSSTLTLSKA DYEKHKVYACEVTHQGLSSPVTKSFNRGEC |
| 78 | 2G6 VH CDR1 | DYGMH |
| 79 | 2G6 VH CDR2 | VIWYDGSNKFYVDSVKG |
| 80 | 2G6 VH CDR3 | GGRLATGHFYYVMDV |
| 81 | 2G6 VL CDR1 | RASQGISSWLA |
| 82 | 2G6 VL CDR2 | AASSLQS |
| 83 | 2G6 VL CDR3 | QQYNSYPYT |
| 84 | 8A6 (VH) | QVQLVESGGGVVQPGRSLRLSCTASGFTFSSYGMQWVRQAPGKGLE WVAVIWYEGSNKYYADSVKGRFTISRENSKNTLYLQMNSLRAEDTA VYYCARGGLMVRGLFYYGMDVWGQGTTVTVSS |
| 85 | 8A6 (VL) | AIQLTQSPSSLSASVGDRVTITCRASQGISSALAWYQQKPGKAPKF LIYDASSLESGVPSRFSGSGSGTDFTLTISSLQPEDFATYYCQQFN SYPYTFGQGTKLEIK |

TABLE 15-continued

SUMMARY OF SEQUENCE LISTING

| SEQ ID | Description | Sequence |
|---|---|---|
| 86 | 8A6 (full length wild-type heavy chain) The constant region is underlined | QVQLVESGGGVVQPGRSLRLSCTASGFTFSSYGMQWVRQAPGKGLE WVAVIWYEGSNKYYADSVKGRFTISRENSKNTLYLQMNSLRAEDTA VYYCARGGLMVRGLFYYGMDVWGQGTTVTVSS<u>ASTKGPSVFPLAPC SRSTSESTAALGCLVKDYFPEPVTVSWNSGALTSGVHTFPAVLQSS GLYSLSSVVTVPSSNFGTQTYTCNVDHKPSNTKVDKTVERKCCVEC PPCPAPPVAGPSVFLFPPKPKDTLMISRTPEVTCVVVDVSHEDPEV QFNWYVDGVEVHNAKTKPREEQFNSTFRVVSVLTVVHQDWLNGKEY KCKVSNKGLPAPIEKTISKTKGQPREPQVYTLPPSREEMTKNQVSL TCLVKGFYPSDIAVEWESNGQPENNYKTTPPMLDSDGSFFLYSKLT VDKSRWQQGNVFSCSVMHEALHNHYTQKSLSLSPGK</u> |
| 87 | 8A6 (full length wild-type light chain) The constant region is underlined | AIQLTQSPSSLSASVGDRVTITCRASQGISSALAWYQQKPGKAPKF LIYDASSLESGVPSRFSGSGSGTDFTLTISSLQPEDFATYYCQQFN SYPYTFGQGTKLEIK<u>RTVAAPSVFIFPPSDEQLKSGTASVVCLLNN FYPREAKVQWKVDNALQSGNSQESVTEQDSKDSTYSLSSTLTLSKA DYEKHKVYACEVTHQGLSSPVTKSFNRGEC</u> |
| 88 | 8A6.IgG1 (VH + IgG1) | QVQLVESGGGVVQPGRSLRLSCTASGFTFSSYGMQWVRQAPGKGLE WVAVIWYEGSNKYYADSVKGRFTISRENSKNTLYLQMNSLRAEDTA VYYCARGGLMVRGLFYYGMDVWGQGTTVTVSSASTKGPSVFPLAPS SKSTSGGTAALGCLVKDYFPEPVTVSWNSGALTSGVHTFPAVLQSS GLYSLSSVVTVPSSSLGTQTYICNVNHKPSNTKVDKRVEPKSCDKT HTCPPCPAPELLGGPSVFLFPPKPKDTLMISRTPEVTCVVVDVSHE DPEVKFNWYVDGVEVHNAKTKPREEQYNSTYRVVSVLTVLHQDWLN GKEYKCKVSNKALPAPIEKTISKAKGQPREPQVYTLPPSREEMTKN QVSLTCLVKGFYPSDIAVEWESNGQPENNYKTTPPVLDSDGSFFLY SKLTVDKSRWQQGNVFSCSVMHEALHNHYTQKSLSLSPG |
| 89 | 8A6.IgG1.1 (VH + IgG1.1) | QVQLVESGGGVVQPGRSLRLSCTASGFTFSSYGMQWVRQAPGKGLE WVAVIWYEGSNKYYADSVKGRFTISRENSKNTLYLQMNSLRAEDTA VYYCARGGLMVRGLFYYGMDVWGQGTTVTVSSASTKGPSVFPLAPS SKSTSGGTAALGCLVKDYFPEPVTVSWNSGALTSGVHTFPAVLQSS GLYSLSSVVTVPSSSLGTQTYICNVNHKPSNTKVDKRVEPKSCDKT HTCPPCPAPE<u>AEGA</u>PSVFLFPPKPKDTLMISRTPEVTCVVVDVSHE DPEVKFNWYVDGVEVHNAKTKPREEQYNSTYRVVSVLTVLHQDWLN GKEYKCKVSNKALP<u>SS</u>IEKTISKAKGQPREPQVYTLPPSREEMTKN QVSLTCLVKGFYPSDIAVEWESNGQPENNYKTTPPVLDSDGSFFLY SKLTVDKSRWQQGNVFSCSVMHEALHNHYTQKSLSLSPG |
| 90 | 8A6.IgG1 (VL + CL) | AIQLTQSPSSLSASVGDRVTITCRASQGISSALAWYQQKPGKAPKF LIYDASSLESGVPSRFSGSGSGTDFTLTISSLQPEDFATYYCQQFN SYPYTFGQGTKLEIKRTVAAPSVFIFPPSDEQLKSGTASVVCLLNN FYPREAKVQWKVDNALQSGNSQESVTEQDSKDSTYSLSSTLTLSKA DYEKHKVYACEVTHQGLSSPVTKSFNRGEC |
| 91 | 8A6 VH CDR1 | SYGMQ |
| 92 | 8A6 VH CDR2 | VIWYEGSNKYYADSVKG |
| 93 | 8A6 VH CDR3 | GGLMVRGLFYYGMDV |
| 94 | 8A6 VL CDR1 | RASQGISSALA |
| 95 | 8A6 VL CDR2 | DASSLES |
| 96 | 8A6 VL CDR3 | QQFNSYPYT |
| 97 | 9G7 (VH) | EVQLVESGGGLVKPGGSLRLSCAASGFTFSTVWMSWVRQAPGKGLE WVGRIKSKTDGGTTDYAAPVKGRFTISRDDSKNTLYLQMNSLHTED TAVYYCTTGQLIPYSYYYGMDVWGQGTSVTVSS |
| 98 | 9G7 (VL1) | EIVLTQSPGTLSLSPGERATLSCRASQSVSSSYLAWYQQKPGQAPR LLIYGASSRATGIPDRFSGSGSGTDFTLTISRLEPEDFAVYYCQQY GSSPWTFGQGTKVEIK |
| 99 | 9G7 (VL2) | EIVLTQSPGTLSLSPGERATLSCRASQSVTSSYLAWYQQKPGQAPR LLIYGASSRATGIPERFSGSGSGTDFTLTISRLEPEDFAVYYCQQY GSSPITFGQGTRLEIK |
| 100 | 9G7 (full length wild-type heavy chain) The constant region is underlined | EVQLVESGGGLVKPGGSLRLSCAASGFTFSTVWMSWVRQAPGKGLE WVGRIKSKTDGGTTDYAAPVKGRFTISRDDSKNTLYLQMNSLHTED TAVYYCTTGQLIPYSYYYGMDVWGQGTSVTVSS<u>ASTKGPSVFPLAP CSRSTSESTAALGCLVKDYFPEPVTVSWNSGALTSGVHTFPAVLQS SGLYSLSSVVTVPSSSLGTKTYTCNVDHKPSNTKVDKRVESKYGPP CPSCPAPEFLGGPSVFLFPPKPKDTLMISRTPEVTCVVVDVSQEDP</u> |

TABLE 15-continued

SUMMARY OF SEQUENCE LISTING

| SEQ ID | Description | Sequence |
|---|---|---|
| | | EVQFNWYVDGVEVHNAKTKPREEQFNSTYRVVSVLTVLHQDWLNGK EYKCKVSNKGLPSSIEKTISKAKGQPREPQVYTLPPSQEEMTKNQV SLTCLVKGFYPSDIAVEWESNGQPENNYKTTPPVLDSDGSFFLYSR LTVDKSRWQEGNVFSCSVMHEALHNHYTQKSLSLSLGK |
| 101 | 9G7 L2 (full length wild-type light chain 2) The constant region is underlined | EIVLTQSPGTLSLSPGERATLSCRASQSVTSSYLAWYQQKPGQAPR LLIYGASSRATGIPERFSGSGSGTDFTLTISRLEPEDFAVYYCQQY GSSPITFGQGTRLEIKRTVAAPSVFIFPPSDEQLKSGTASVVCLLN NFYPREAKVQWKVDNALQSGNSQESVTEQDSKDSTYSLSSTLTLSK ADYEKHKVYACEVTHQGLSSPVTKSFNRGEC |
| 102 | 9G7.IgG1 (VH + IgG1) | EVQLVESGGGLVKPGGSLRLSCAASGFTFSTVWMSWVRQAPGKGLE WVGRIKSKTDGGTTDYAAPVKGRFTISRDDSKNTLYLQMNSLHTED TAVYYCTTGQLIPYSYYYGMDVWGQGTSVTVSSASTKGPSVFPLAP SSKSTSGGTAALGCLVKDYFPEPVTVSWNSGALTSGVHTFPAVLQS SGLYSLSSVVTVPSSSLGTQTYICNVNHKPSNTKVDKRVEPKSCDK THTCPPCPAPELLGGPSVFLFPPKPKDTLMISRTPEVTCVVVDVSH EDPEVKFNWYVDGVEVHNAKTKPREEQYNSTYRVVSVLTVLHQDWL NGKEYKCKVSNKALPAPIEKTISKAKGQPREPQVYTLPPSREEMTK NQVSLTCLVKGFYPSDIAVEWESNGQPENNYKTTPPVLDSDGSFFL YSKLTVDKSRWQQGNVFSCSVMHEALHNHYTQKSLSLSPG |
| 103 | 9G7.IgG1.1 (VH + IgG1.1) | EVQLVESGGGLVKPGGSLRLSCAASGFTFSTVWMSWVRQAPGKGLE WVGRIKSKTDGGTTDYAAPVKGRFTISRDDSKNTLYLQMNSLHTED TAVYYCTTGQLIPYSYYYGMDVWGQGTSVTVSSASTKGPSVFPLAP SSKSTSGGTAALGCLVKDYFPEPVTVSWNSGALTSGVHTFPAVLQS SGLYSLSSVVTVPSSSLGTQTYICNVNHKPSNTKVDKRVEPKSCDK THTCPPCPAPEAEGAPSVFLFPPKPKDTLMISRTPEVTCVVVDVSH EDPEVKFNWYVDGVEVHNAKTKPREEQYNSTYRVVSVLTVLHQDWL NGKEYKCKVSNKALPSSIEKTISKAKGQPREPQVYTLPPSREEMTK NQVSLTCLVKGFYPSDIAVEWESNGQPENNYKTTPPVLDSDGSFFL YSKLTVDKSRWQQGNVFSCSVMHEALHNHYTQKSLSLSPG |
| 104 | 9G7.IgG1 (VL1 + CL) | EIVLTQSPGTLSLSPGERATLSCRASQSVSSSYLAWYQQKPGQAPR LLIYGASSRATGIPDRFSGSGSGTDFTLTISRLEPEDFAVYYCQQY GSSPWTFGQGTKVEIKRTVAAPSVFIFPPSDEQLKSGTASVVCLLN NFYPREAKVQWKVDNALQSGNSQESVTEQDSKDSTYSLSSTLTLSK ADYEKHKVYACEVTHQGLSSPVTKSFNRGEC |
| 105 | 9G7.IgG1.2 (VL2 + CL) | EIVLTQSPGTLSLSPGERATLSCRASQSVTSSYLAWYQQKPGQAPR LLIYGASSRATGIPERFSGSGSGTDFTLTISRLEPEDFAVYYCQQY GSSPITFGQGTRLEIKRTVAAPSVFIFPPSDEQLKSGTASVVCLLN NFYPREAKVQWKVDNALQSGNSQESVTEQDSKDSTYSLSSTLTLSK ADYEKHKVYACEVTHQGLSSPVTKSFNRGEC |
| 106 | 9G7 VH CDR1 | TVWMS |
| 107 | 9G7 VH CDR2 | RIKSKTDGGTTDYAAPVKG |
| 108 | 9G7 VH CDR3 | GQLIPYSYYYGMDV |
| 109 | 9G7 VL1 CDR1 | RASQSVSSSYLA |
| 110 | 9G7 VL1 CDR2 | GASSRAT |
| 111 | 9G7 VL1 CDR3 | QQYGSSPWT |
| 112 | 9G7 VL2 CDR1 | RASQSVTSSYLA |
| 113 | 9G7 VL2 CDR2 | GASSRAT |
| 114 | 9G7 VL2 CDR3 | QQYGSSPIT |
| 115 | 14E3 (VH) | QVQLQQWGAGLLKPSETLSLTCAVYGGSFSGYYWSWIRQPPGKGLE WIGEINHSGNTYYNPSLKSRVTISVDTSKNQLSLKLSSVTAADTAV YYCARFGSNDAFDIWGQGTMVTVSS |
| 116 | 14E3 (VL) | DIQMTQSPSSLSASVGDRVTITCRASQGISSWLAWYQQKPEKAPKS LIYAASSLQSGVPSRFSGSGSGTDFTLTISSLQPEDFATYYCQQYN SYPPTFGQGTKVEIK |
| 117 | 14E3 (full length wild-type heavy chain) The constant region is underlined | QVQLQQWGAGLLKPSETLSLTCAVYGGSFSGYYWSWIRQPPGKGLE WIGEINHSGNTYYNPSLKSRVTISVDTSKNQLSLKLSSVTAADTAV YYCARFGSNDAFDIWGQGTMVTVSSASTKGPSVFPLAPSSKSTSGG TAALGCLVKDYFPEPVTVSWNSGALTSGVHTFPAVLQSSGLYSLSS |

TABLE 15-continued

SUMMARY OF SEQUENCE LISTING

| SEQ ID | Description | Sequence |
|---|---|---|
| | | VVTVPSSSLGTQTYICNVNHKPSNTKVDKRVEPKSCDKTHTCPPCP<br>APELLGGPSVFLFPPKPKDTLMISRTPEVTCVVVDVSHEDPEVKFN<br>WYVDGVEVHNAKTKPREEQYNSTYRVVSVLTVLHQDWLNGKEYKCK<br>VSNKALPAPIEKTISKAKGQPREPQVYTLPPSRDELTKNQVSLTCL<br>VKGFYPSDIAVEWESNGQPENNYKTTPPVLDSDGSFFLYSKLTVDK<br>SRWQQGNVFSCSVMHEALHNHYTQKSLSLSPGK |
| 118 | 14E3 (full length wild-type light chain)<br>The constant region is underlined | DIQMTQSPSSLSASVGDRVTITCRASQGISSWLAWYQQKPEKAPKS<br>LIYAASSLQSGVPSRFSGSGSGTDFTLTISSLQPEDFATYYCQQYN<br>SYPPTFGQGTKVEIKRTVAAPSVFIFPPSDEQLKSGTASVVCLLNN<br>FYPREAKVQWKVDNALQSGNSQESVTEQDSKDSTYSLSSTLTLSKA<br>DYEKHKVYACEVTHQGLSSPVTKSFNRGEC |
| 119 | 14E3.IgG1 (VH + IgG1) | QVQLQQWGAGLLKPSETLSLTCAVYGGSFSGYYWSWIRQPPGKGLE<br>WIGEINHSGNTYYNPSLKSRVTISVDTSKNQLSLKLSSVTAADTAV<br>YYCARFGSNDAFDIWGQGTMVTVSSASTKGPSVFPLAPSSKSTSGG<br>TAALGCLVKDYFPEPVTVSWNSGALTSGVHTFPAVLQSSGLYSLSS<br>VVTVPSSSLGTQTYICNVNHKPSNTKVDKRVEPKSCDKTHTCPPCP<br>APELLGGPSVFLF<br>PPKPKDTLMISRTPEVTCVVVDVSHEDPEVKFNWYVDGVE<br>VHNAKTKPREEQYNSTYRVVSVLTVLHQDWLNGKEYKCKV<br>SNKALPAPIEKTISKAKGQPREPQVYTLPPSREEMTKNQVSLTCLV<br>KGFYPSDIAVEWESNGQPENNYKTTPPVLDSDGSFFLYSKLTVDKS<br>RWQQGNVFSCSVMHEALHNHYTQKSLSLSPG |
| 120 | 14E3.IgG1.1 (VH + IgG1.1) | QVQLQQWGAGLLKPSETLSLTCAVYGGSFSGYYWSWIRQPPGKGLE<br>WIGEINHSGNTYYNPSLKSRVTISVDTSKNQLSLKLSSVTAADTAV<br>YYCARFGSNDAFDIWGQGTMVTVSSASTKGPSVFPLAPSSKSTSGG<br>TAALGCLVKDYFPEPVTVSWNSGALTSGVHTFPAVLQSSGLYSLSS<br>VVTVPSSSLGTQTYICNVNHKPSNTKVDKRVEPKSCDKTHTCPPCP<br>APEAEGAPSVFLFPPKPKDTLMISRTPEVTCVVVDVSHEDPEVKFN<br>WYVDGVEVHNAKTKPREEQYNSTYRVVSVLTVLHQDWLNGKEYKCK<br>VSNKALPSSIEKTISKAKGQPREPQVYTLPPSREEMTKNQVSLTCL<br>VKGFYPSDIAVEWESNGQPENNYKTTPPVLDSDGSFFLYSKLTVDK<br>SRWQQGNVFSCSVMHEALHNHYTQKSLSLSPG |
| 121 | 14E3.IgG1 (VL + CL) | DIQMTQSPSSLSASVGDRVTITCRASQGISSWLAWYQQKPEKAPKS<br>LIYAASSLQSGVPSRFSGSGSGTDFTLTISSLQPEDFATYYCQQYN<br>SYPPTFGQGTKVEIKRTVAAPSVFIFPPSDEQLKSGTASVVCLLNN<br>FYPREAKVQWKVDNALQSGNSQESVTEQDSKDSTYSLSSTLTLSKA<br>DYEKHKVYACEVTHQGLSSPVTKSFNRGEC |
| 122 | 14E3 VH CDR1 | GYYWS |
| 123 | 14E3 VH CDR2 | EINHSGNTYYNPSLKS |
| 124 | 14E3 VH CDR3 | FGSNDAFDI |
| 125 | 14E3 VL CDR1 | RASQGISSWLA |
| 126 | 14E3 VL CDR2 | AASSLQS |
| 127 | 14E3 VL CDR3 | QQYNSYPPT |
| 128 | 19H8 (VH) | QVQLVESGGGVVQPGRSLRLSCAASGFTFSNYGMHWVRQAPGKGLE<br>WMAVIWYGGSNKFYADSVKGRFTISRDNSKNSLSLQMNSLRAEDTA<br>VYYCARGGAMVRGVYYYGMDVWGQGTTVTVSS |
| 129 | 19H8 (VL1) | AIQLTQSPSSLSASVGDRVTITCRASQGISSALAWYQQKPGKAPKF<br>LIYDASSLESGVPSRFSGSGSGTDFTLTISSLQPEDFATYYCQQFN<br>SYPQTFGQGTKVEIK |
| 130 | 19H8 (VL2) | EIVLTQSPATLSLSPGERATLSCRASQSVSSYLAWYQQKPGQAPRL<br>LIYDASNRATGIPARFSGSGSGTDFTLTISSLEPEDFAVYYCQQRS<br>NWPLTFGGGTKVEIK |

TABLE 15-continued

SUMMARY OF SEQUENCE LISTING

| SEQ ID | Description | Sequence |
|---|---|---|
| 131 | 19H8 (full length wild-type heavy chain) The constant region is underlined | QVQLVESGGGVVQPGRSLRLSCAASGFTFSNYGMHWVRQAPGKGLE WMAVIWYGGSNKFYADSVKGRFTISRDNSKNSLSLQMNSLRAEDTA VYYCARGGAMVRGVYYYGMDVWGQGTTVTVSS<u>ASTKGPSVFPLAPC SRSTSESTAALGCLVKDYFPEPVTVSWNSGALTSGVHTFPAVLQSS GLYSLSSVVTVPSSNFGTQTYTCNVDHKPSNTKVDKTVERKCCVEC PPCPAPPVAGPSVFLFPPKPKDTLMISRTPEVTCVVVDVSHEDPEV QFNWYVDGVEVHNAKTKPREEQFNSTFRVVSVLTVVHQDWLNGKEY KCKVSNKGLPAPIEKTISKTKGQPREPQVYTLPPSREEMTKNQVSL TCLVKGFYPSDIAVEWESNGQPENNYKTTPPMLDSDGSFFLYSKLT VDKSRWQQGNVFSCSVMHEALHNHYTQKSLSLSPGK</u> |
| 132 | 19H8 L1 (full length wild-type light chain 1) The constant region is underlined | AIQLTQSPSSLSASVGDRVTITCRASQGISSALAWYQQKPGKAPKF LIYDASSLESGVPSRFSGSGSGTDFTLTISSLQPEDFATYYCQQFN SYPQTFGQGTKVEIK<u>RTVAAPSVFIFPPSDEQLKSGTASVVCLLNN FYPREAKVQWKVDNALQSGNSQESVTEQDSKDSTYSLSSTLTLSKA DYEKHKVYACEVTHQGLSSPVTKSFNRGEC</u> |
| 133 | 19H8 L2 (full length wild-type light chain 2) | EIVLTQSPATLSLSPGERATLSCRASQSVSSYLAWYQQKPGQAPRL LIYDASNRATGIPARFSGSGSGTDFTLTISSLEPEDFAVYYCQQRS NWPLTFGGGTKVEIK<u>RTVAAPSVFIFPPSDEQLKSGTASVVCLLNN FYPREAKVQWKVDNALQSGNSQESVTEQDSKDSTYSLSSTLTLSKA DYEKHKVYACEVTHQGLSSPVTKSFNRGEC</u> |
| 134 | 19H8.IgG1 (VH + IgG1) | QVQLVESGGGVVQPGRSLRLSCAASGFTFSNYGMHWVRQAPGKGLE WMAVIWYGGSNKFYADSVKGRFTISRDNSKNSLSLQMNSLRAEDTA VYYCARGGAMVRGVYYYGMDVWGQGTTVTVSSASTKGPSVFPLAPS SKSTSGGTAALGCLVKDYFPEPVTVSWNSGALTSGVHTFPAVLQSS GLYSLSSVVTVPSSSLGTQTYICNVNHKPSNTKVDKRVEPKSCDKT HTCPPCPAPELLGGPSVFLF PPKPKDTLMISRTPEVTCVVVDVSHEDPEVKFNWYVDGVE VHNAKTKPREEQYNSTYRVVSVLTVLHQDWLNGKEYKCKV SNKALPAPIEKTISKAKGQPREPQVYTLPPSREEMTKNQVSLTCLV KGFYPSDIAVEWESNGQPENNYKTTPPVLDSDGSFFLYSKLTVDKS RWQQGNVFSCSVMHEALHNHYTQKSLSLSPG |
| 135 | 19H8.IgG1.1 (VH + IgG1.1) | QVQLVESGGGVVQPGRSLRLSCAASGFTFSNYGMHWVRQAPGKGLE WMAVIWYGGSNKFYADSVKGRFTISRDNSKNSLSLQMNSLRAEDTA VYYCARGGAMVRGVYYYGMDVWGQGTTVTVSSASTKGPSVFPLAPS SKSTSGGTAALGCLVKDYFPEPVTVSWNSGALTSGVHTFPAVLQSS GLYSLSSVVTVPSSSLGTQTYICNVNHKPSNTKVDKRVEPKSCDKT HTCPPCPAPE<u>AEGA</u>PSVFLFPPKPKDTLMISRTPEVTCVVVDVSHE DPEVKFNWYVDGVEVHNAKTKPREEQYNSTYRVVSVLTVLHQDWLN GKEYKCKVSNKALP<u>SS</u>IEKTISKAKGQPREPQVYTLPPSREEMTKN QVSLTCLVKGFYPSDIAVEWESNGQPENNYKTTPPVLDSDGSFFLY SKLTVDKSRWQQGNVFSCSVMHEALHNHYTQKSLSLSPG |
| 136 | 19H8.IgG1 (VL1 + CL) | AIQLTQSPSSLSASVGDRVTITCRASQGISSALAWYQQKPGKAPKF LIYDASSLESGVPSRFSGSGSGTDFTLTISSLQPEDFATYYCQQFN SYPQTFGQGTKVEIKRTVAAPSVFIFPPSDEQLKSGTASVVCLLNN FYPREAKVQWKVDNALQSGNSQESVTEQDSKDSTYSLSSTLTLSKA DYEKHKVYACEVTHQGLSSPVTKSFNRGEC |
| 137 | 19H8.IgG1.2 (VL2 + CL) | EIVLTQSPATLSLSPGERATLSCRASQSVSSYLAWYQQKPGQAPRL LIYDASNRATGIPARFSGSGSGTDFTLTISSLEPEDFAVYYCQQRS NWPLTFGGGTKVEIKRTVAAPSVFIFPPSDEQLKSGTASVVCLLNN FYPREAKVQWKVDNALQSGNSQESVTEQDSKDSTYSLSSTLTLSKA DYEKHKVYACEVTHQGLSSPVTKSFNRGEC |
| 138 | 19H8 VH CDR1 | NYGMH |
| 139 | 19H8 VH CDR2 | VIWYGGSNKFYADSVKG |
| 140 | 19H8 VH CDR3 | GGAMVRGVYYYGMDV |
| 141 | 19H8 VL1 CDR1 | RASQGISSALA |
| 142 | 19H8 VL1 CDR2 | DASSLES |
| 143 | 19H8 VL1 CDR3 | QQFNSYPQT |
| 144 | 19H8 VL2 CDR1 | RASQSVSSYLA |
| 145 | 19H8 VL2 CDR2 | DASNRAT |
| 146 | 19H8 VL2 CDR3 | QQRSNWPLT |

TABLE 15-continued

SUMMARY OF SEQUENCE LISTING

| SEQ ID | Description | Sequence |
|---|---|---|
| 147 | 28F3 (VH) nucleotide sequence | CAGGTGCAGCTGGTGGAGTCTGGGGGAGGCGTGGTCCAGCCTGGGA<br>GGTCCCTGAGACTCTCCTGTGCAGCGTCTGGATTCACCTTCAGTAG<br>CTATGGCATGCACTGGGTCCGCCAGGCTCCAGGCAAGGGGCTGGAG<br>TGGGTGGCAGTTATATGGTATGAAGGAAGTAATAAATATTATGCAG<br>ACTCCGTGAAGGGCCGATTCACCATCTCCAGAGACAATTCCAAGAA<br>CACGCTGTATCTGCAAATGAACAGCCTGAGAGCCGAGGACACGGCT<br>GTGTATTACTGTGCGAGAGGGGGAGTATGGTTCGGGGGGACTACT<br>ACTACGGTATGGACGTCTGGGGCCAAGGGACCACGGTCACCGTCTC<br>CTCA |
| 148 | 28F3 (VL) nucleotide sequence | GCCATCCAGTTGACCCAGTCTCCATCCTCCCTGTCTGCATCTGTAG<br>GAGACAGAGTCACCATCACTTGCCGGGCAAGTCAGGGCATTAGCAG<br>TGCTTTAGCCTGGTATCAGCAGAAACCAGGGAAAGCTCCTAAGCTC<br>CTGATCTATGATGCCTCCAGTTTGGAAAGTGGGGTCCCATCAAGGT<br>TCAGCGGCAGTGGATCTGGGACAGATTTCACTCTCACCATCAGCAG<br>CCTGCAGCCTGAAGATTTTGCAACTTATTACTGTCAACAGTTTAAT<br>AGTTACCCGTACACTTTTGGCCAGGGGACCAAGCTGGAGATCAAA |
| 149 | 28F3 (full length wild-type heavy chain) nucleotide sequence<br>The sequence encoding the constant region is underlined | CAGGTGCAGCTGGTGGAGTCTGGGGGAGGCGTGGTCCAGCCTGGGA<br>GGTCCCTGAGACTCTCCTGTGCAGCGTCTGGATTCACCTTCAGTAG<br>CTATGGCATGCACTGGGTCCGCCAGGCTCCAGGCAAGGGGCTGGAG<br>TGGGTGGCAGTTATATGGTATGAAGGAAGTAATAAATATTATGCAG<br>ACTCCGTGAAGGGCCGATTCACCATCTCCAGAGACAATTCCAAGAA<br>CACGCTGTATCTGCAAATGAACAGCCTGAGAGCCGAGGACACGGCT<br>GTGTATTACTGTGCGAGAGGGGGAGTATGGTTCGGGGGGACTACT<br>ACTACGGTATGGACGTCTGGGGCCAAGGGACCACGGTCACCGTCTC<br>CTCAGCCTCCACCAAGGGCCCATCGGTCTTCCCCCTGGCGCCCTGC<br>TCCAGGAGCACCTCCGAGAGCACAGCGGCCCTGGGCTGCCTGGTCA<br>AGGACTACTTCCCCGAACCGGTGACGGTGTCGTGGAACTCAGGCGC<br>TCTGACCAGCGGCGTGCACACCTTCCCAGCTGTCCTACAGTCCTCA<br>GGACTCTACTCCCTCAGCAGCGTGGTGACCGTGCCCTCCAGCAACT<br>TCGGCACCCAGACCTACACCTGCAACGTAGATCACAAGCCCAGCAA<br>CACCAAGGTGGACAAGACAGTTGAGCGCAAATGTTGTGTCGAGTGC<br>CCACCGTGCCCAGCACCACCTGTGGCAGGACCGTCAGTCTTCCTCT<br>TCCCCCCAAAACCCAAGGACACCCTCATGATCTCCCGGACCCCTGA<br>GGTCACGTGCGTGGTGGTGGACGTGAGCCACGAAGACCCCGAGGTC<br>CAGTTCAACTGGTACGTGGACGGCGTGGAGGTGCATAATGCCAAGA<br>CAAAGCCACGGGAGGAGCAGTTCAACAGCACGTTCCGTGTGGTCAG<br>CGTCCTCACCGTTGTGCACCAGGACTGGCTGAACGGCAAGGAGTAC<br>AAGTGCAAGGTCTCCAACAAAGGCCTCCCAGCCCCCATCGAGAAAA<br>CCATCTCCAAAACCAAAGGGCAGCCCCGAGAACCACAGGTGTACAC<br>CCTGCCCCCATCCCGGGAGGAGATGACCAAGAACCAGGTCAGCCTG<br>ACCTGCCTGGTCAAAGGCTTCTACCCCAGCGACATCGCCGTGGAGT<br>GGGAGAGCAATGGGCAGCCGGAGAACAACTACAAGACCACACCTCC<br>CATGCTGGACTCCGACGGCTCCTTCTTCCTCTACAGCAAGCTCACC<br>GTGGACAAGAGCAGGTGGCAGCAGGGGAACGTCTTCTCATGCTCCG<br>TGATGCATGAGGCTCTGCACAACCACTACACGCAGAAGAGCCTCTC<br>CCTGTCTCCGGGTAAA |
| 150 | 28F3 (full length wild-type light chain) nucleotide sequence<br>The sequence encoding the constant region is underlined | GCCATCCAGTTGACCCAGTCTCCATCCTCCCTGTCTGCATCTGTAG<br>GAGACAGAGTCACCATCACTTGCCGGGCAAGTCAGGGCATTAGCAG<br>TGCTTTAGCCTGGTATCAGCAGAAACCAGGGAAAGCTCCTAAGCTC<br>CTGATCTATGATGCCTCCAGTTTGGAAAGTGGGGTCCCATCAAGGT<br>TCAGCGGCAGTGGATCTGGGACAGATTTCACTCTCACCATCAGCAG<br>CCTGCAGCCTGAAGATTTTGCAACTTATTACTGTCAACAGTTTAAT<br>AGTTACCCGTACACTTTTGGCCAGGGGACCAAGCTGGAGATCAAAC<br>GAACTGTGGCTGCACCATCTGTCTTCATCTTCCCGCCATCTGATGA<br>GCAGTTGAAATCTGGAACTGCCTCTGTTGTGTGCCTGCTGAATAAC<br>TTCTATCCCAGAGAGGCCAAAGTACAGTGGAAGGTGGATAACGCCC<br>TCCAATCGGGTAACTCCCAGGAGAGTGTCACAGAGCAGGACAGCAA<br>GGACAGCACCTACAGCCTCAGCAGCACCCTGACGCTGAGCAAAGCA<br>GACTACGAGAAACACAAAGTCTACGCCTGCGAAGTCACCCATCAGG<br>GCCTGAGCTCGCCCGTCACAAAGAGCTTCAACAGGGGAGAGTGT |
| 151 | 28F3.IgG1 (VH + IgG1) nucleotide sequence | caggtgcagc tggtggagtc tgggggaggc gtggtccagc<br>ctgggaggtc cctgagactc tcctgtgcag cgtctggatt<br>caccttcagt agctatggca tgcactgggt ccgccaggct<br>ccaggcaagg ggctggagtg ggtggcagtt atatggtatg<br>aaggaagtaa taaatattat gcagactccg tgaagggccg<br>attcaccatc tccagagaca attccaagaa cacgctgtat<br>ctgcaaatga acagcctgag agccgaggac acggctgtgt<br>attactgtgc gagagggggg agtatggttc gggggggacta |

TABLE 15-continued

SUMMARY OF SEQUENCE LISTING

| SEQ ID | Description | Sequence |
|---|---|---|
| | | ctactacggt atggacgtct ggggccaagg gaccacggtc<br>accgtctcct cagctagcac caagggccca tcggtcttcc<br>ccctggcacc ctcctccaag agcacctctg ggggcacagc<br>ggccctgggc tgcctggtca aggactactt ccccgaaccg<br>gtgacggtgt cgtggaactc aggcgccctg accagcggcg<br>tgcacacctt cccggctgtc ctacagtcct caggactcta<br>ctccctcagc agcgtggtga ccgtgccctc agcagcttg<br>ggcacccaga cctacatctg caacgtgaat cacaagccca<br>gcaacaccaa ggtggacaag agagttgagc ccaaatcttg<br>tgacaaaact cacacatgcc caccgtgccc agcacctgaa<br>ctcctggggg gaccgtcagt cttcctcttc cccccaaaac<br>ccaaggacac cctcatgatc tcccggaccc ctgaggtcac<br>atgcgtggtg gtggacgtga gccacgaaga ccctgaggtc<br>aagttcaact ggtacgtgga cggcgtggag gtgcataatg<br>ccaagacaaa gccgcgggag gagcagtaca acagcacgta<br>ccgtgtggtc agcgtcctca ccgtcctgca ccaggactgg<br>ctgaatggca aggagtacaa gtgcaaggtc tccaacaaag<br>ccctcccagc ccccatcgag aaaaccatct ccaaagccaa<br>agggcagccc cgagaaccac aggtgtacac cctgcccca<br>tcccgggagg agatgaccaa gaaccaggtc agcctgacct<br>gcctggtcaa aggcttctat cccagcgaca tcgccgtgga<br>gtgggagagc aatgggcagc cggagaacaa ctacaagacc<br>acgcctcccg tgctggactc cgacggctcc ttcttcctct<br>atagcaagct caccgtggac aagagcaggt ggcagcaggg<br>gaacgtcttc tcatgctccg tgatgcatga ggctctgcac<br>aaccactaca cgcagaagag cctctccctg tccccgggtt ga |
| 152 | 28F3.IgG1.1 (VH + IgG1.1) nucleotide sequence | caggtgcagc tggtggagtc tgggggaggc gtggtccagc<br>ctgggaggtc cctgagactc tcctgtgcag cgtctggatt<br>caccttcagt agctatggca tgcactgggt ccgccaggct<br>ccaggcaagg ggctggagtg ggtggcagtt atatggtatg<br>aaggaagtaa taaatattat gcagactccg tgaagggccg<br>attcaccatc tccagagaca attccaagaa cacgctgtat<br>ctgcaaatga acagcctgag agccgaggac acggctgtgt<br>attactgtgc gagagggggg agtatggttc gggggactag<br>ctactacggt atggacgtct ggggccaagg gaccacggtc<br>accgtctcct cagctagcac caagggccca tcggtcttcc<br>ccctggcacc ctcctccaag agcacctctg ggggcacagc<br>ggccctgggc tgcctggtca aggactactt ccccgaaccg<br>gtgacggtgt cgtggaactc aggcgccctg accagcggcg<br>tgcacacctt cccggctgtc ctacagtcct caggactcta<br>ctccctcagc agcgtggtga ccgtgccctc agcagcttg<br>ggcacccaga cctacatctg caacgtgaat cacaagccca<br>gcaacaccaa ggtggacaag agagttgagc ccaaatcttg<br>tgacaaaact cacacatgcc caccgtgccc agcacctgaa<br>gccgaagggg ccccgtcagt cttcctcttc cccccaaaac<br>ccaaggacac cctcatgatc tcccggaccc ctgaggtcac<br>atgcgtggtg gtggacgtga gccacgaaga ccctgaggtc<br>aagttcaact ggtacgtgga cggcgtggag gtgcataatg<br>ccaagacaaa gccgcgggag gagcagtaca acagcacgta<br>ccgtgtggtc agcgtcctca ccgtcctgca ccaggactgg<br>ctgaatggca aggagtacaa gtgcaaggtc tccaacaaag<br>ccctcccaag cagcatcgag aaaaccatct ccaaagccaa<br>agggcagccc cgagaaccac aggtgtacac cctgcccca<br>tcccgggagg agatgaccaa gaaccaggtc agcctgacct<br>gcctggtcaa aggcttctat cccagcgaca tcgccgtgga<br>gtgggagagc aatgggcagc cggagaacaa ctacaagacc<br>acgcctcccg tgctggactc cgacggctcc ttcttcctct<br>atagcaagct caccgtggac aagagcaggt ggcagcaggg<br>gaacgtcttc tcatgctccg tgatgcatga ggctctgcac<br>aaccactaca cgcagaagag cctctccctg tccccgggtt ga |
| 153 | 28F3.IgG1 (VL + CL) nucleotide sequence | gccatccagt tgacccagtc tccatcctcc ctgtctgcat<br>ctgtaggaga cagagtcacc atcacttgcc gggcaagtca<br>gggcattagc agtgctttag cctggtatca gcagaaacca<br>gggaaagctc ctaagctcct gatctatgat gcctccagtt<br>tggaaagtgg ggtcccatca aggttcagcg gcagtggatc<br>tgggacagat ttcactctca ccatcagcag cctgcagcct<br>gaagattttg caacttatta ctgtcaacag tttaatagtt<br>acccgtacac ttttggccag gggaccaagc tggagatcaa<br>acgtacggtg gctgcaccat ctgtcttcat cttcccgcca<br>tctgatgagc agttgaaatc tggaactgcc tctgttgtgt<br>gcctgctgaa taacttctat cccagagagg ccaaagtaca<br>gtggaaggtg gataacgccc tccaatcggg taactcccag<br>gagagtgtca cagagcagga cagcaaggac agcacctaca |

TABLE 15-continued

SUMMARY OF SEQUENCE LISTING

| SEQ ID | Description | Sequence |
|---|---|---|
| | | gcctcagcag caccctgacg ctgagcaaag cagactacga gaaacacaaa gtctacgcct gcgaagtcac ccatcagggc ctgagctcgc ccgtcacaaa gagcttcaac aggggagagt gttag |
| 154 | 19D3 (VH) nucleotide sequence | CAGGTGCAGCTGGTGGAGTCTGGGGGAGGCGTGGTCCAACCTGGGA GGTCCCTGAGACTCTCCTGTGCAGCGTCTGGATTCACCTTCAGTAG CTATGGCTTCCACTGGGTCCGCCAGGCTCCAGGCAAGGGGCTGGAG TGGGTGGCAGTTATATGGTATGCTGGAAGTAATAAATTCTATGCAG ACTCCGTGAAGGGCCGATTCACCATCTCCAGAGACAATTCCAAGAA CACGCTGTATCTGCAAATGAACAGCCTAAGAGCCGAGGACACGGCT GTGTATTACTGTGCGAGAGGGGGACAGTTGGACTACTACTACTATT ACGTTATGGACGTCTGGGGCCAAGGGACCACGGTCACCGTCTCCTCA |
| 155 | 19D3 (VL) nucleotide sequence | GACATCCAGATGACCCAGTCTCCATCCTCACTGTCTGCATCTGTAG GAGACAGAGTCACCATCACTTGTCGGGCGAGTCAGGGTATTAGCAG CTGGTTAGCCTGGTATCAGCAGAAACCAGAGAAAGCCCCTAAGTCC CTGATCTATGCTGCATCCAGTTTGCAAAGTGGGGTCCCATCAAGGT TCAGCGGCAGTGGATCTGGGACAGATTTCACTCTCACCATCAGCAG CCTGCAGCCTGAAGATTTTGCAACTTATTACTGCCAACAGTATAAT AGTTACCCGTACACTTTTGGCCAGGGGACCAAGCTGGAGATCAAA |
| 156 | 19D3 (full length wild-type heavy chain) nucleotide sequence The sequence encoding the constant region is underlined | CAGGTGCAGCTGGTGGAGTCTGGGGGAGGCGTGGTCCAACCTGGGA GGTCCCTGAGACTCTCCTGTGCAGCGTCTGGATTCACCTTCAGTAG CTATGGCTTCCACTGGGTCCGCCAGGCTCCAGGCAAGGGGCTGGAG TGGGTGGCAGTTATATGGTATGCTGGAAGTAATAAATTCTATGCAG ACTCCGTGAAGGGCCGATTCACCATCTCCAGAGACAATTCCAAGAA CACGCTGTATCTGCAAATGAACAGCCTAAGAGCCGAGGACACGGCT GTGTATTACTGTGCGAGAGGGGGACAGTTGGACTACTACTACTATT ACGTTATGGACGTCTGGGGCCAAGGGACCACGGTCACCGTCTCCTC <u>AGCCTCCACCAAGGGCCCATCGGTCTTCCCCCTGGCGCCCTGCTCC AGGAGCACCTCCGAGAGCACAGCGGCCCTGGGCTGCCTGGTCAAGG ACTACTTCCCCGAACCGGTGACGGTGTCGTGGAACTCAGGCGCTCT GACCAGCGGCGTGCACACCTTCCCAGCTGTCCTACAGTCCTCAGGA CTCTACTCCCTCAGCAGCGTGGTGACCGTGCCCTCCAGCAACTTCG GCACCCAGACCTACACCTGCAACGTAGATCACAAGCCCAGCAACAC CAAGGTGGACAAGACAGTTGAGCGCAAATGTTGTGTCGAGTGCCCA CCGTGCCCAGCACCACCTGTGGCAGGACCGTCAGTCTTCCTCTTCC CCCCAAAACCCAAGGACACCCTCATGATCTCCCGGACCCCTGAGGT CACGTGCGTGGTGGTGGACGTGAGCCACGAAGACCCCGAGGTCCAG TTCAACTGGTACGTGGACGGCGTGGAGGTGCATAATGCCAAGACAA AGCCACGGGAGGAGCAGTTCAACAGCACGTTCCGTGTGGTCAGCGT CCTCACCGTTGTGCACCAGGACTGGCTGAACGGCAAGGAGTACAAG TGCAAGGTCTCCAACAAAGGCCTCCCAGCCCCCATCGAGAAAACCA TCTCCAAAACCAAAGGGCAGCCCCGAGAACCACAGGTGTACACCCT GCCCCCATCCCGGGAGGAGATGACCAAGAACCAGGTCAGCCTGACC TGCCTGGTCAAAGGCTTCTACCCCAGCGACATCGCCGTGGAGTGGG AGAGCAATGGGCAGCCGGAGAACAACTACAAGACCACACCTCCCAT GCTGGACTCCGACGGCTCCTTCTTCCTCTACAGCAAGCTCACCGTG GACAAGAGCAGGTGGCAGCAGGGGAACGTCTTCTCATGCTCCGTGA TGCATGAGGCTCTGCACAACCACTACACGCAGAAGAGCCTCTCCCT GTCTCCGGGTAAA</u> |
| 157 | 19D3 (full length wild-type light chain) nucleotide sequence The sequence encoding the constant region is underlined | GACATCCAGATGACCCAGTCTCCATCCTCACTGTCTGCATCTGTAG GAGACAGAGTCACCATCACTTGTCGGGCGAGTCAGGGTATTAGCAG CTGGTTAGCCTGGTATCAGCAGAAACCAGAGAAAGCCCCTAAGTCC CTGATCTATGCTGCATCCAGTTTGCAAAGTGGGGTCCCATCAAGGT TCAGCGGCAGTGGATCTGGGACAGATTTCACTCTCACCATCAGCAG CCTGCAGCCTGAAGATTTTGCAACTTATTACTGCCAACAGTATAAT AGTTACCCGTACACTTTTGGCCAGGGGACCAAGCTGGAGATCAAA<u>C GAACTGTGGCTGCACCATCTGTCTTCATCTTCCCGCCATCTGATGA GCAGTTGAAATCTGGAACTGCCTCTGTTGTGTGCCTGCTGAATAAC TTCTATCCCAGAGAGGCCAAAGTACAGTGGAAGGTGGATAACGCCC TCCAATCGGGTAACTCCCAGGAGAGTGTCACAGAGCAGGACAGCAA GGACAGCACCTACAGCCTCAGCAGCACCCTGACGCTGAGCAAAGCA GACTACGAGAAACACAAAGTCTACGCCTGCGAAGTCACCCATCAGG GCCTGAGCTCGCCCGTCACAAAGAGCTTCAACAGGGGAGAGTGT</u> |
| 158 | 18E10 (VH) nucleotide sequence | CAGGTGCAGCTGGTGGAGTCTGGGGGAGGCGTGGTCCAGCCTGGGA GGTCCCTGAGACTCTCCTGTGCAGCGTCTGGATTCACCTTCAGTAG CTATGGCATGCACTGGGTCCGCCAGGCTCCAGGCAAGGGGCTGGAG TGGGTGGCAGTTATATGGTATGCTGGAAGTAATAAATACTATGCAG ACTCCGTGAAGGGCCGATTCACCATCTCCAGAGACAATTCCAAGAA CACGCTGTATCTGCAAATGAACAGCCTGAGAGCCGAGGACACGGCT |

TABLE 15-continued

SUMMARY OF SEQUENCE LISTING

| SEQ ID | Description | Sequence |
|---|---|---|
| | | GTGTATTACTGTGCGAGAGGGGGCGTATAGCAGTGGCCTTCTACT<br>ACAGTATGGACGTCTGGGGCCAAGGGACCACGGTCACCGTCTCCTC<br>A |
| 159 | 18E10 (VL) nucleotide sequence | GACATCCAGATGACCCAGTCTCCATCCTCACTGTCTGCATCTGTAG<br>GAGACAGAGTCACCATCACTTGTCGGGCGAGTCAGGGTATTAGCAG<br>CTGGTTAGCCTGGTATCAGCAGAAACCAGAGAAAGCCCCTAAGTCC<br>CTGATCTATGCTGCATCCAGTTTGCAAAGTGGGGTCCCATCAAGGT<br>TCAGCGGCAGTGGATCTGGGACAGATTTCACTCTCACCATCAGCAG<br>CCTGCAGCCTGAAGATTTTGCAACTTATTACTGCCAACAGTATAAT<br>AGTTACCCGTACACTTTTGGCCAGGGGACCAAGCTGGAGATCAAA |
| 160 | 18E10 (full length wild-type heavy chain) nucleotide sequence | CAGGTGCAGCTGGTGGAGTCTGGGGGAGGCGTGGTCCAGCCTGGGA<br>GGTCCCTGAGACTCTCCTGTGCAGCGTCTGGATTCACCTTCAGTAG<br>CTATGGCATGCACTGGGTCCGCCAGGCTCCAGGCAAGGGGCTGGAG<br>TGGGTGGCAGTTATATGGTATGCTGGAAGTAATAAATACTATGCAG<br>ACTCCGTGAAGGGCCGATTCACCATCTCCAGAGACAATTCCAAGAA<br>CACGCTGTATCTGCAAATGAACAGCCTGAGAGCCGAGGACACGGCT<br>GTGTATTACTGTGCGAGAGGGGGCGTATAGCAGTGGCCTTCTACT<br>ACAGTATGGACGTCTGGGGCCAAGGGACCACGGTCACCGTCTCCTC<br>AGCCTCCACCAAGGGCCCATCGGTCTTCCCCCTGGCGCCCTGCTCC<br>AGGAGCACCTCCGAGAGCACAGCGGCCCTGGGCTGCCTGGTCAAGG<br>ACTACTTCCCCGAACCGGTGACGGTGTCGTGGAACTCAGGCGCTCT<br>GACCAGCGGCGTGCACACCTTCCCAGCTGTCCTACAGTCCTCAGGA<br>CTCTACTCCCTCAGCAGCGTGGTGACCGTGCCCTCCAGCAACTTCG<br>GCACCCAGACCTACACCTGCAACGTAGATCACAAGCCCAGCAACAC<br>CAAGGTGGACAAGACAGTTGAGCGCAAATGTTGTGTCGAGTGCCCA<br>CCGTGCCCAGCACCACCTGTGGCAGGACCGTCAGTCTTCCTCTTCC<br>CCCCAAAACCCAAGGACACCCTCATGATCTCCCGGACCCCTGAGGT<br>CACGTGCGTGGTGGTGGACGTGAGCCACGAAGACCCCGAGGTCCAG<br>TTCAACTGGTACGTGGACGGCGTGGAGGTGCATAATGCCAAGACAA<br>AGCCACGGGAGGAGCAGTTCAACAGCACGTTCCGTGTGGTCAGCGT<br>CCTCACCGTTGTGCACCAGGACTGGCTGAACGGCAAGGAGTACAAG<br>TGCAAGGTCTCCAACAAAGGCCTCCCAGCCCCCATCGAGAAAACCA<br>TCTCCAAAACCAAAGGGCAGCCCCGAGAACCACAGGTGTACACCCT<br>GCCCCCATCCCGGGAGGAGATGACCAAGAACCAGGTCAGCCTGACC<br>TGCCTGGTCAAAGGCTTCTACCCCAGCGACATCGCCGTGGAGTGGG<br>AGAGCAATGGGCAGCCGGAGAACAACTACAAGACCACACCTCCCAT<br>GCTGGACTCCGACGGCTCCTTCTTCCTCTACAGCAAGCTCACCGTG<br>GACAAGAGCAGGTGGCAGCAGGGGAACGTCTTCTCATGCTCCGTGA<br>TGCATGAGGCTCTGCACAACCACTACACGCAGAAGAGCCTCTCCCT<br>GTCTCCGGGTAAA |
| 161 | 18E10 (full length wild-type light chain) nucleotide sequence | GACATCCAGATGACCCAGTCTCCATCCTCACTGTCTGCATCTGTAG<br>GAGACAGAGTCACCATCACTTGTCGGGCGAGTCAGGGTATTAGCAG<br>CTGGTTAGCCTGGTATCAGCAGAAACCAGAGAAAGCCCCTAAGTCC<br>CTGATCTATGCTGCATCCAGTTTGCAAAGTGGGGTCCCATCAAGGT<br>TCAGCGGCAGTGGATCTGGGACAGATTTCACTCTCACCATCAGCAG<br>CCTGCAGCCTGAAGATTTTGCAACTTATTACTGCCAACAGTATAAT<br>AGTTACCCGTACACTTTTGGCCAGGGGACCAAGCTGGAGATCAAAC<br>GAACTGTGGCTGCACCATCTGTCTTCATCTTCCCGCCATCTGATGA<br>GCAGTTGAAATCTGGAACTGCCTCTGTTGTGTGCCTGCTGAATAAC<br>TTCTATCCCAGAGAGGCCAAAGTACAGTGGAAGGTGGATAACGCCC<br>TCCAATCGGGTAACTCCCAGGAGAGTGTCACAGAGCAGGACAGCAA<br>GGACAGCACCTACAGCCTCAGCAGCACCCTGACGCTGAGCAAAGCA<br>GACTACGAGAAACACAAAGTCTACGCCTGCGAAGTCACCCATCAGG<br>GCCTGAGCTCGCCCGTCACAAAGAGCTTCAACAGGGGAGAGTGT |
| 162 | 3C3 (VH) nucleotide sequence | CAGGTGCAACTACAGCAGTGGGGCGCAGGACTGTTGAAGCCTTCGG<br>AGACCCTGTCCCTCACCTGCGCTGTCTATGGTGGGTCCTTCAGTGG<br>TTACTACTGGACCTGGATCCGCCAGCCCCCAGGGAAGGGGCTGGAG<br>TGGATTGGGAAATCAATCATAGTGGAAACACCAACTACAACCCGT<br>CCCTCAAGAGTCGAGTCACCATATCAGTAGACACGTCCAAGAACCA<br>GTTCTCCCTGAAGCTGAGCTCTGTGACCGCCGCGGACACGGCTGTG<br>TATTACTGTGCGAGACTGGGGCCTTTGATGCTTTTGATATCTGGG<br>GCCAAGGGACAATGGTCACCGTCTCTTCA |
| 163 | 3C3 (VL1) nucleotide sequence | GACATCCAGATGACCCAGTCTCCATCCTCACTGTCTGCATCTGTAG<br>GAGACAGAGTCACCATCACTTGTCGGGCGAGTCAGGGTATTAGCAG<br>CTGGTTAGCCTGGTATCAGCAGAAACCAGAGAAAGCCCCTAAGTCC<br>CTGATCTATGCTGCATCCAGTTTGCAAAGTGGGGTCCCATCAAGGT<br>TCAGCGGCAGTGGATCTGGGACAGATTTCACTCTCACCATCAGCAG<br>CCTGCAGCCTGAAGATTTTGCAACTTATTACTGCCAACAGTATAAT<br>AGTTACCCGTACACTTTTGGCCAGGGGACCAAGCTGGAGATCAAA |

TABLE 15-continued

SUMMARY OF SEQUENCE LISTING

| SEQ ID | Description | Sequence |
|---|---|---|
| 164 | 3C3 (VL2) nucleotide sequence | GAAATTGTGTTGACACAGTCTCCAGCCACCCTGTCTTTGTCTCCAG<br>GGGAAAGAGCCACCCTCTCCTGCAGGGCCAGTCAGGGTGTTAGCAG<br>CTACTTAGCCTGGTACCAGCAGAAACCTGGCCAGGCTCCCAGGCTC<br>CTCATCTATGATGCATCCAACAGGGCCACTGGCATCCCAGCCAGGT<br>TCAGTGGCAGTGGGCCTGGGACAGACTTCACTCTCACCATCAGCAG<br>CCTAGAGCCTGAAGATTTTGCAGTTTATTACTGTCAGCAGCGTAGC<br>AACTGGCACACTTTTGGCCAGGGGACCAAGCTGGAGATCAAA |
| 165 | 3C3 (full length wild-type heavy chain) nucleotide sequence<br>The sequence encoding the constant region is underlined | CAGGTGCAACTACAGCAGTGGGGCGCAGGACTGTTGAAGCCTTCGG<br>AGACCCTGTCCCTCACCTGCGCTGTCTATGGTGGGTCCTTCAGTGG<br>TTACTACTGGACCTGGATCCGCCAGCCCCCAGGGAAGGGGCTGGAG<br>TGGATTGGGAAAATCAATCATAGTGGAAACACCAACTACAACCCGT<br>CCCTCAAGAGTCGAGTCACCATATCAGTAGACACGTCCAAGAACCA<br>GTTCTCCCTGAAGCTGAGCTCTGTGACCGCCGCGGACACGGCTGTG<br>TATTACTGTGCGAGACTGGGGGCCTTTGATGCTTTTGATATCTGGG<br>GCCAAGGGACAATGGTCACCGTCTCTTCAGCCTCCACCAAGGGCCC<br>ATCGGTCTTCCCCCTGGCACCCTCCTCCAAGAGCACCTCTGGGGGC<br>ACAGCGGCCCTGGGCTGCCTGGTCAAGGACTACTTCCCCGAACCGG<br>TGACGGTGTCGTGGAACTCAGGCGCCCTGACCAGCGGCGTGCACAC<br>CTTCCCGGCTGTCCTACAGTCCTCAGGACTCTACTCCCTCAGCAGC<br>GTGGTGACCGTGCCCTCCAGCAGCTTGGGCACCCAGACCTACATCT<br>GCAACGTGAATCACAAGCCCAGCAACACCAAGGTGGACAAGAGAGT<br>TGAGCCCAAATCTTGTGACAAAACTCACACATGCCCACCGTGCCCA<br>GCACCTGAACTCCTGGGGGGACCGTCAGTCTTCCTCTTCCCCCCAA<br>AACCCAAGGACACCCTCATGATCTCCCGGACCCCTGAGGTCACATG<br>CGTGGTGGTGGACGTGAGCCACGAAGACCCTGAGGTCAAGTTCAAC<br>TGGTACGTGGACGGCGTGGAGGTGCATAATGCCAAGACAAAGCCGC<br>GGGAGGAGCAGTACAACAGCACGTACCGTGTGGTCAGCGTCCTCAC<br>CGTCCTGCACCAGGACTGGCTGAATGGCAAGGAGTACAAGTGCAAG<br>GTCTCCAACAAAGCCCTCCCAGCCCCCATCGAGAAAACCATCTCCA<br>AAGCCAAAGGGCAGCCCCGAGAACCACAGGTGTACACCCTGCCCCC<br>ATCCCGGGATGAGCTGACCAAGAACCAGGTCAGCCTGACCTGCCTG<br>GTCAAAGGCTTCTATCCCAGCGACATCGCCGTGGAGTGGGAGAGCA<br>ATGGGCAGCCGGAGAACAACTACAAGACCACGCCTCCCGTGCTGGA<br>CTCCGACGGCTCCTTCTTCCTCTACAGCAAGCTCACCGTGGACAAG<br>AGCAGGTGGCAGCAGGGGAACGTCTTCTCATGCTCCGTGATGCATG<br>AGGCTCTGCACAACCACTACACGCAGAAGAGCCTCTCCCTGTCTCC<br>GGGTAAA |
| 166 | 3C3 L1 (full length wild-type light chain) nucleotide sequence<br>The sequence encoding the constant region is underlined | GACATCCAGATGACCCAGTCTCCATCCTCACTGTCTGCATCTGTAG<br>GAGACGAGTCACCATCACTTGTCGGGCGAGTCAGGGTATTAGCAG<br>CTGGTTAGCCTGGTATCAGCAGAAACCAGAGAAAGCCCCTAAGTCC<br>CTGATCTATGCTGCATCCAGTTTGCAAAGTGGGGTCCCATCAAGGT<br>TCAGCGGCAGTGGATCTGGGACAGATTTCACTCTCACCATCAGCAG<br>CCTGCAGCCTGAAGATTTTGCAACTTATTACTGCCAACAGTATAAT<br>AGTTACCCGTACACTTTTGGCCAGGGGACCAAGCTGGAGATCAAA<u>C</u><br><u>GAACTGTGGCTGCACCATCTGTCTTCATCTTCCCGCCATCTGATGA</u><br><u>GCAGTTGAAATCTGGAACTGCCTCTGTTGTGTGCCTGCTGAATAAC</u><br><u>TTCTATCCCAGAGAGGCCAAAGTACAGTGGAAGGTGGATAACGCCC</u><br><u>TCCAATCGGGTAACTCCCAGGAGAGTGTCACAGAGCAGGACAGCAA</u><br><u>GGACAGCACCTACAGCCTCAGCAGCACCCTGACGCTGAGCAAAGCA</u><br><u>GACTACGAGAAACACAAAGTCTACGCCTGCGAAGTCACCCATCAGG</u><br><u>GCCTGAGCTCGCCCGTCACAAAGAGCTTCAACAGGGGAGAGTGT</u> |
| 167 | 3C3 L2 (full length wild-type light chain) nucleotide sequence<br>The sequence encoding the constant region is underlined | GAAATTGTGTTGACACAGTCTCCAGCCACCCTGTCTTTGTCTCCAG<br>GGGAAAGAGCCACCCTCTCCTGCAGGGCCAGTCAGGGTGTTAGCAG<br>CTACTTAGCCTGGTACCAGCAGAAACCTGGCCAGGCTCCCAGGCTC<br>CTCATCTATGATGCATCCAACAGGGCCACTGGCATCCCAGCCAGGT<br>TCAGTGGCAGTGGGCCTGGGACAGACTTCACTCTCACCATCAGCAG<br>CCTAGAGCCTGAAGATTTTGCAGTTTATTACTGTCAGCAGCGTAGC<br>AACTGGCACACTTTTGGCCAGGGGACCAAGCTGGAGATCAAA<u>CGAA</u><br><u>CTGTGGCTGCACCATCTGTCTTCATCTTCCCGCCATCTGATGAGCA</u><br><u>GTTGAAATCTGGAACTGCCTCTGTTGTGTGCCTGCTGAATAACTTC</u><br><u>TATCCCAGAGAGGCCAAAGTACAGTGGAAGGTGGATAACGCCCTCC</u><br><u>AATCGGGTAACTCCCAGGAGAGTGTCACAGAGCAGGACAGCAAGGA</u><br><u>CAGCACCTACAGCCTCAGCAGCACCCTGACGCTGAGCAAAGCAGAC</u><br><u>TACGAGAAACACAAAGTCTACGCCTGCGAAGTCACCCATCAGGGCC</u><br><u>TGAGCTCGCCCGTCACAAAGAGCTTCAACAGGGGAGAGTGT</u> |
| 168 | 2G6 (VH) nucleotide sequence | CAGGTTCAGCTGGTGGAGTCTGGGGGAGGCGTGGTCCAGCCTGGGG<br>GGTCCCTGAGACTCTCCTGTGCAGCGTCTGGATTCATCTTGAGTGA<br>CTATGGCATGCACTGGGTCCGCCAGGCTCCAGGCAAGGGACTGGAG<br>TGGGTGACAGTTATCTGGTATGATGGAAGTAATAAATTCTATGTAG<br>ACTCCGTGAAGGGCCGATTCACCATCTCCAGAGACAATTCCAAGAA<br>CACGTTGTATCTGCAAATGAACAGCCTGAGAGTCGAGGACACGGCT |

TABLE 15-continued

SUMMARY OF SEQUENCE LISTING

| SEQ ID | Description | Sequence |
|---|---|---|
| | | GTGTATTACTGTGCGAGAGGGGACGTCTAGCAACAGGTCACTTCT<br>ACTACGTTATGGACGTCTGGGGCCAAGGGACCACGGTCACCGTCTC<br>CTCA |
| 169 | 2G6 (VL) nucleotide sequence | GACATCCAGATGACCCAGTCTCCATCCTCACTGTCTGCATCTGTAG<br>GAGACAGAGTCACCATCACTTGTCGGGCGAGTCAGGGTATTAGCAG<br>CTGGTTAGCCTGGTATCAGCAGAAACCAGAGAAAGCCCCTAAGTCC<br>CTGATCTATGCTGCATCCAGTTTGCAAAGTGGGGTCCCATCAAGGT<br>TCAGCGGCAGTGGATCTGGGACAGATTTCACTCTCACCATCAGCAG<br>CCTGCAGCCTGAAGATTTTGCAACTTATTACTGCCAACAGTATAAT<br>AGTTACCCGTACACTTTTGGCCAGGGGACCAAGCTGGAGATCAAA |
| 170 | 2G6 (full length wild-type heavy chain) nucleotide sequence<br>The sequence encoding the constant region is underlined | CAGGTTCAGCTGGTGGAGTCTGGGGGAGGCGTGGTCCAGCCTGGGG<br>GGTCCCTGAGACTCTCCTGTGCAGCGTCTGGATTCATCTTGAGTGA<br>CTATGGCATGCACTGGGTCCGCCAGGCTCCAGGCAAGGGACTGGAG<br>TGGGTGACAGTTATCTGGTATGATGGAAGTAATAAATTCTATGTAG<br>ACTCCGTGAAGGGCCGATTCACCATCTCCAGAGACAATTCCAAGAA<br>CACGTTGTATCTGCAAATGAACAGCCTGAGAGTCGAGGACACGGCT<br>GTGTATTACTGTGCGAGAGGGGACGTCTAGCAACAGGTCACTTCT<br>ACTACGTTATGGACGTCTGGGGCCAAGGGACCACGGTCACCGTCTC<br>CTCAGCCTCCACCAAGGGCCCATCGGTCTTCCCCCTGGCGCCCTGC<br>TCCAGGAGCACCTCCGAGAGCACAGCGGCCCTGGGCTGCCTGGTCA<br>AGGACTACTTCCCCGAACCGGTGACGGTGTCGTGGAACTCAGGCGC<br>TCTGACCAGCGGCGTGCACACCTTCCCAGCTGTCCTACAGTCCTCA<br>GGACTCTACTCCCTCAGCAGCGTGGTGACCGTGCCCTCCAGCAACT<br>TCGGCACCCAGACCTACACCTGCAACGTAGATCACAAGCCCAGCAA<br>CACCAAGGTGGACAAGACAGTTGAGCGCAAATGTTGTGTCGAGTGC<br>CCACCGTGCCCAGCACCACCTGTGGCAGGACCGTCAGTCTTCCTCT<br>TCCCCCCAAAACCCAAGGACACCCTCATGATCTCCCGGACCCCTGA<br>GGTCACGTGCGTGGTGGTGGACGTGAGCCACGAAGACCCCGAGGTC<br>CAGTTCAACTGGTACGTGGACGGCGTGGAGGTGCATAATGCCAAGA<br>CAAAGCCACGGGAGGAGCAGTTCAACAGCACGTTCCGTGTGGTCAG<br>CGTCCTCACCGTTGTGCACCAGGACTGGCTGAACGGCAAGGAGTAC<br>AAGTGCAAGGTCTCCAACAAAGGCCTCCCAGCCCCCATCGAGAAAA<br>CCATCTCCAAACCCAAAGGGCAGCCCCGAGAACCACAGGTGTACAC<br>CCTGCCCCCATCCCGGGAGGAGATGACCAAGAACCAGGTCAGCCTG<br>ACCTGCCTGGTCAAAGGCTTCTACCCCAGCGACATCGCCGTGGAGT<br>GGGAGAGCAATGGGCAGCCGGAGAACAACTACAAGACCACACCTCC<br>CATGCTGGACTCCGACGGCTCCTTCTTCCTCTACAGCAAGCTCACC<br>GTGGACAAGAGCAGGTGGCAGCAGGGGAACGTCTTCTCATGCTCCG<br>TGATGCATGAGGCTCTGCACAACCACTACACGCAGAAGAGCCTCTC<br>CCTGTCTCCGGGTAAA |
| 171 | 2G6 (full length wild-type light chain) nucleotide sequence<br>The sequence encoding the constant region is underlined | GACATCCAGATGACCCAGTCTCCATCCTCACTGTCTGCATCTGTAG<br>GAGACAGAGTCACCATCACTTGTCGGGCGAGTCAGGGTATTAGCAG<br>CTGGTTAGCCTGGTATCAGCAGAAACCAGAGAAAGCCCCTAAGTCC<br>CTGATCTATGCTGCATCCAGTTTGCAAAGTGGGGTCCCATCAAGGT<br>TCAGCGGCAGTGGATCTGGGACAGATTTCACTCTCACCATCAGCAG<br>CCTGCAGCCTGAAGATTTTGCAACTTATTACTGCCAACAGTATAAT<br>AGTTACCCGTACACTTTTGGCCAGGGGACCAAGCTGGAGATCAAAC<br>GAACTGTGGCTGCACCATCTGTCTTCATCTTCCCGCCATCTGATGA<br>GCAGTTGAAATCTGGAACTGCCTCTGTTGTGTGCCTGCTGAATAAC<br>TTCTATCCCAGAGAGGCCAAAGTACAGTGGAAGGTGGATAACGCCC<br>TCCAATCGGGTAACTCCCAGGAGAGTGTCACAGAGCAGGACAGCAA<br>GGACAGCACCTACAGCCTCAGCAGCACCCTGACGCTGAGCAAAGCA<br>GACTACGAGAAACACAAAGTCTACGCCTGCGAAGTCACCCATCAGG<br>GCCTGAGCTCGCCCGTCACAAAGAGCTTCAACAGGGGAGAGTGT |
| 172 | 8A6 (VH) nucleotide sequence | CAGGTGCAGCTGGTGGAGTCTGGGGGAGGCGTGGTCCAGCCTGGGA<br>GGTCCCTGAGACTCTCCTGTACAGCGTCTGGATTCACCTTCAGTAG<br>CTATGGCATGCAGTGGGTCCGCCAGGCTCCAGGCAAGGGGCTGGAG<br>TGGGTGGCAGTTATATGGTATGAAGGAAGTAATAAATACTATGCAG<br>ACTCCGTGAAGGGCCGATTCACCATCTCCAGAGAAAATTCCAAGAA<br>CACGCTGTATCTGCAAATGAACAGCCTGAGAGCCGAGGACACGGCT<br>GTGTATTACTGTGCGAGAGGCGGTCTTATGGTTCGGGGTCTCTTCT<br>ACTACGGTATGGACGTCTGGGGCCAAGGGACCACGGTCAC<br>CGTCTCCTCA |
| 173 | 8A6 (VL) nucleotide sequence | GCCATCCAGTTGACCCAGTCTCCATCCTCCCTGTCTGCATCTGTAG<br>GAGACAGAGTCACCATCACTTGCCGGGCAAGTCAGGGCATTAGCAG<br>TGCTTTAGCCTGGTATCAGCAGAAACCAGGGAAAGCTCCTAAGTTC<br>CTGATCTATGATGCCTCCAGTTTGGAAAGTGGGGTCCCATCAAGGT<br>TCAGCGGCAGTGGATCTGGGACAGATTTCACTCTCACCATCAGCAG<br>CCTGCAGCCTGAAGATTTTGCAACTTATTACTGTCAACAGTTTAAT<br>AGTTACCCGTACACTTTTGGCCAGGGGACCAAGCTGGAGATCAAA |

TABLE 15-continued

SUMMARY OF SEQUENCE LISTING

| SEQ ID | Description | Sequence |
|---|---|---|
| 174 | 8A6 (full length wild-type heavy chain) nucleotide sequence The sequence encoding the constant region is underlined | CAGGTGCAGCTGGTGGAGTCTGGGGGAGGCGTGGTCCAGCCTGGGA GGTCCCTGAGACTCTCCTGTACAGCGTCTGGATTCACCTTCAGTAG CTATGGCATGCAGTGGGTCCGCCAGGCTCCAGGCAAGGGGCTGGAG TGGGTGGCAGTTATATGGTATGAAGGAAGTAATAAATACTATGCAG ACTCCGTGAAGGGCCGATTCACCATCTCCAGAGAAAATTCCAAGAA CACGCTGTATCTGCAAATGAACAGCCTGAGAGCCGAGGACACGGCT GTGTATTACTGTGCGAGAGGCGGTCTTATGGTTCGGGGTCTCTTCT ACTACGGTATGGACGTCTGGGGCCAAGGGACCACGGTCACCGTCTC CTCAGCCTCCACCAAGGGCCCATCGGTCTTCCCCCTGGCGCCCTGC TCCAGGAGCACCTCCGAGAGCACAGCGGCCCTGGGCTGCCTGGTCA AGGACTACTTCCCCGAACCGGTGACGGTGTCGTGGAACTCAGGCGC TCTGACCAGCGGCGTGCACACCTTCCCAGCTGTCCTACAGTCCTCA GGACTCTACTCCCTCAGCAGCGTGGTGACCGTGCCCTCCAGCAACT TCGGCACCCAGACCTACACCTGCAACGTAGATCACAAGCCCAGCAA CACCAAGGTGGACAAGACAGTTGAGCGCAAATGTTGTGTCGAGTGC CCACCGTGCCCAGCACCACCTGTGGCAGGACCGTCAGTCTTCCTCT TCCCCCCAAAACCCAAGGACACCCTCATGATCTCCCGGACCCCTGA GGTCACGTGCGTGGTGGTGGACGTGAGCCACGAAGACCCCGAGGTC CAGTTCAACTGGTACGTGGACGGCGTGGAGGTGCATAATGCCAAGA CAAAGCCACGGGAGGAGCAGTTCAACAGCACGTTCCGTGTGGTCAG CGTCCTCACCGTTGTGCACCAGGACTGGCTGAACGGCAAGGAGTAC AAGTGCAAGGTCTCCAACAAAGGCCTCCCAGCCCCCATCGAGAAAA CCATCTCCAAAACCAAAGGGCAGCCCCGAGAACCACAGGTGTACAC CCTGCCCCCATCCCGGGAGGAGATGACCAAGAACCAGGTCAGCCTG ACCTGCCTGGTCAAAGGCTTCTACCCCAGCGACATCGCCGTGGAGT GGGAGAGCAATGGGCAGCCGGAGAACAACTACAAGACCACACCTCC CATGCTGGACTCCGACGGCTCCTTCTTCCTCTACAGCAAGCTCACC GTGGACAAGAGCAGGTGGCAGCAGGGGAACGTCTTCTCATGCTCCG TGATGCATGAGGCTCTGCACAACCACTACACGCAGAAGAGCCTCTC CCTGTCTCCGGGTAAA |
| 175 | 8A6 (full length wild-type light chain) nucleotide sequence The sequence encoding the constant region is underlined | GCCATCCAGTTGACCCAGTCTCCATCCTCCCTGTCTGCATCTGTAG GAGACAGAGTCACCATCACTTGCCGGGCAAGTCAGGGCATTAGCAG TGCTTTAGCCTGGTATCAGCAGAAACCAGGGAAAGCTCCTAAGTTC CTGATCTATGATGCCTCCAGTTTGGAAAGTGGGGTCCCATCAAGGT TCAGCGGCAGTGGATCTGGGACAGATTTCACTCTCACCATCAGCAG CCTGCAGCCTGAAGATTTTGCAACTTATTACTGTCAACAGTTTAAT AGTTACCCGTACACTTTTGGCCAGGGGACCAAGCTGGAGATCAAAC GAACTGTGGCTGCACCATCTGTCTTCATCTTCCCGCCATCTGATGA GCAGTTGAAATCTGGAACTGCCTCTGTTGTGTGCCTGCTGAATAAC TTCTATCCCAGAGAGGCCAAAGTACAGTGGAAGGTGGATAACGCCC TCCAATCGGGTAACTCCCAGGAGAGTGTCACAGAGCAGGACAGCAA GGACAGCACCTACAGCCTCAGCAGCACCCTGACGCTGAGCAAAGCA GACTACGAGAAACACAAAGTCTACGCCTGCGAAGTCACCCATCAGG GCCTGAGCTCGCCCGTCACAAAGAGCTTCAACAGGGGAGAGTGT |
| 176 | 9G7 (VH) nucleotide sequence | GAGGTGCAGCTGGTGGAGTCTGGGGGAGGCTTAGTAAAGCCTGGGG GGTCCCTTAGACTCTCCTGTGCAGCCTCTGGATTCACTTTCAGTAC CGTCTGGATGAGCTGGGTCCGCCAGGCTCCAGGGAAGGGGCTGGAG TGGGTTGGCCGTATTAAAAGCAAAACTGATGGTGGGACAACAGACT ACGCTGCACCCGTGAAAGGCAGATTCACCATCTCAAGAGATGATTC AAAAAAACACGCTGTATCTGCAAATGAACAGCCTGCACACCGAGGAC ACAGCCGTGTATTACTGTACCACAGGGCAGCTGATCCCTTACTCCT ACTACTACGGTATGGACGTCTGGGGCCAAGGGACCTCGGT CACCGTCTCCTCA |
| 177 | 9G7 (VL1) nucleotide sequence | GAAATTGTGTTGACGCAGTCTCCAGGCACCCTGTCTTTGTCTCCAG GGGAAAGAGCCACCCTCTCCTGCAGGGCCAGTCAGAGTGTTAGCAG CAGCTACTTAGCCTGGTACCAGCAGAAACCTGGCCAGGCTCCCAGG CTCCTCATCTATGGTGCATCCAGCAGGGCCACTGGCATCCCAGACA GGTTCAGTGGCAGTGGGTCTGGGACAGACTTCACTCTCACCATCAG CAGACTGGAGCCTGAAGATTTTGCAGTGTATTACTGTCAGCAGTAT GGTAGCTCACCGTGGACGTTCGGCCAAGGGACCAAGGTGGAAATCA AA |
| 178 | 9G7 (VL2) nucleotide sequence | GAAATTGTGTTGACGCAGTCTCCAGGCACCCTGTCTTTGTCTCCAG GGGAAAGAGCCACCCTCTCCTGCAGGGCCAGTCAGAGTGTTACCAG CAGCTACTTAGCCTGGTACCAGCAGAAACCTGGCCAGGCTCCCAGG CTCCTCATCTATGGTGCATCCAGCAGGGCCACTGGCATCCCAGAGA GGTTCAGTGGCAGTGGGTCTGGGACAGACTTCACTCTCACCATCAG CAGACTGGAGCCTGAAGATTTTGCAGTGTATTACTGTCAGCAGTAT GGTAGCTCACCGATCACCTTCGGCCAAGGGACACGACTGGAGATTA AA |

TABLE 15-continued

SUMMARY OF SEQUENCE LISTING

| SEQ ID | Description | Sequence |
|---|---|---|
| 179 | 9G7 (full length wild-type heavy chain) nucleotide sequence The sequence encoding the constant region is underlined | GAGGTGCAGCTGGTGGAGTCTGGGGGAGGCTTAGTAAAGCCTGGGG GGTCCCTTAGACTCTCCTGTGCAGCCTCTGGATTCACTTTCAGTAC CGTCTGGATGAGCTGGGTCCGCCAGGCTCCAGGGAAGGGGCTGGAG TGGGTTGGCCGTATTAAAAGCAAAACTGATGGTGGGACAACAGACT ACGCTGCACCCGTGAAAGGCAGATTCACCATCTCAAGAGATGATTC AAAAAACACGCTGTATCTGCAAATGAACAGCCTGCACACCGAGGAC ACAGCCGTGTATTACTGTACCACAGGGCAGCTGATCCCTTACTCCT ACTACTACGGTATGGACGTCTGGGGCCAAGGGACCTCGGTCACCGT CTCCTCAGCTTCCACCAAGGGCCCATCCGTCTTCCCCCTGGCGCCC TGCTCCAGGAGCACCTCCGAGAGCACAGCCGCCCTGGGCTGCCTGG TCAAGGACTACTTCCCCGAACCGGTGACGGTGTCGTGGAACTCAGG CGCCCTGACCAGCGGCGTGCACACCTTCCCGGCTGTCCTACAGTCC TCAGGACTCTACTCCCTCAGCAGCGTGGTGACCGTGCCCTCCAGCA GCTTGGGCACGAAGACCTACACCTGCAACGTAGATCACAAGCCCAG CAACACCAAGGTGGACAAGAGAGTTGAGTCCAAATATGGTCCCCCA TGCCCATCATGCCCAGCACCTGAGTTCCTGGGGGGACCATCAGTCT TCCTGTTCCCCCCAAAACCCAAGGACACTCTCATGATCTCCCGGAC CCCTGAGGTCACGTGCGTGGTGGTGGACGTGAGCCAGGAAGACCCC GAGGTCCAGTTCAACTGGTACGTGGATGGCGTGGAGGTGCATAATG CCAAGACAAAGCCGCGGGAGGAGCAGTTCAACAGCACGTACCGTGT GGTCAGCGTCCTCACCGTCCTGCACCAGGACTGGCTGAACGGCAAG GAGTACAAGTGCAAGGTCTCCAACAAAGGCCTCCCGTCCTCCATCG AGAAAACCATCTCCAAAGCCAAAGGGCAGCCCCGAGAGCCACAGGT GTACACCCTGCCCCCATCCCAGGAGGAGATGACCAAGAACCAGGTC AGCCTGACCTGCCTGGTCAAAGGCTTCTACCCCAGCGACATCGCCG TGGAGTGGGAGAGCAATGGGCAGCCGGAGAACAACTACAAGACCAC GCCTCCCGTGCTGGACTCCGACGGCTCCTTCTTCCTCTACAGCAGG CTAACCGTGGACAAGAGCAGGTGGCAGGAGGGGAATGTCTTCTCAT GCTCCGTGATGCATGAGGCTCTGCACAACCACTACACACAGAAGAG CCTCTCCCTGTCTCTGGGTAAA |
| 180 | 9G7 L2 (full length wild-type light chain) nucleotide sequence The sequence encoding the constant region is underlined | GAAATTGTGTTGACGCAGTCTCCAGGCACCCTGTCTTTGTCTCCAG GGGAAAGAGCCACCCTCTCCTGCAGGGCCAGTCAGAGTGTTACCAG CAGCTACTTAGCCTGGTACCAGCAGAAACCTGGCCAGGCTCCCAGG CTCCTCATCTATGGTGCATCCAGCAGGGCCACTGGCATCCCAGAGA GGTTCAGTGGCAGTGGGTCTGGGACAGACTTCACTCTCACCATCAG CAGACTGGAGCCTGAAGATTTTGCAGTGTATTACTGTCAGCAGTAT GGTAGCTCACCGATCACCTTCGGCCAAGGGACACGACTGGAGATTA AACGAACTGTGGCTGCACCATCTGTCTTCATCTTCCCGCCATCTGA TGAGCAGTTGAAATCTGGAACTGCCTCTGTTGTGTGCCTGCTGAAT AACTTCTATCCCAGAGAGGCCAAAGTACAGTGGAAGGTGGATAACG CCCTCCAATCGGGTAACTCCCAGGAGAGTGTCACAGAGCAGGACAG CAAGGACAGCACCTACAGCCTCAGCAGCACCCTGACGCTGAGCAAA GCAGACTACGAGAAACACAAAGTCTACGCCTGCGAAGTCACCCATC AGGGCCTGAGCTCGCCCGTCACAAAGAGCTTCAACAGGGGAGAGTG T |
| 181 | 9G7 L1 (full length wild-type light chain) nucleotide sequence The sequence encoding the constant region is underlined | GAAATTGTGTTGACGCAGTCTCCAGGCACCCTGTCTTTGTCTCCAG GGGAAAGAGCCACCCTCTCCTGCAGGGCCAGTCAGAGTGTTAGCAG CAGCTACTTAGCCTGGTACCAGCAGAAACCTGGCCAGGCTCCCAGG CTCCTCATCTATGGTGCATCCAGCAGGGCCACTGGCATCCCAGACA GGTTCAGTGGCAGTGGGTCTGGGACAGACTTCACTCTCACCATCAG CAGACTGGAGCCTGAAGATTTTGCAGTGTATTACTGTCAGCAGTAT GGTAGCTCACCGTGGACGTTCGGCCAAGGGACCAAGGTGGAAATCA AACGAACTGTGGCTGCACCATCTGTCTTCATCTTCCCGCCATCTGA TGAGCAGTTGAAATCTGGAACTGCCTCTGTTGTGTGCCTGCTGAAT AACTTCTATCCCAGAGAGGCCAAAGTACAGTGGAAGGTGGATAACG CCCTCCAATCGGGTAACTCCCAGGAGAGTGTCACAGAGCAGGACAG CAAGGACAGCACCTACAGCCTCAGCAGCACCCTGACGCTGAGCAAA GCAGACTACGAGAAACACAAAGTCTACGCCTGCGAAGTCACCCATC AGGGCCTGAGCTCGCCCGTCACAAAGAGCTTCAACAGGGGAGAGTG T |
| 182 | 14E3 (VH) nucleotide sequence | CAGGTGCAGCTACAGCAGTGGGGCGCAGGACTGTTGAAGCCTTCGG AGACCCTGTCCCTCACCTGCGCTGTCTATGGTGGGTCCTTCAGTGG TTACTACTGGAGCTGGATCCGCCAGCCCCCAGGGAAGGGGCTGGAG TGGATTGGAGAAATCAATCATAGTGGAAACACCTACTACAACCCGT CCCTCAAGAGTCGCGTCACCATATCAGTAGACACGTCAAGAACCA GTTATCCTGAAGCTGAGCTCTGTGACCGCCGCGGACACGGCTGTG TATTACTGTGCGAGATTTGGGAGTAATGATGCTTTTGATATCTGGG GCCAAGGGACAATGGTCACCGTCTCTTCA |
| 183 | 14E3 (VL) nucleotide sequence | GACATCCAGATGACCCAGTCTCCATCCTCACTGTCTGCATCTGTAG GAGACAGAGTCACCATCACTTGTCGGGCGAGTCAGGGTATTAGCAG CTGGTTAGCCTGGTATCAGCAGAAACCAGAGAAAGCCCCTAAGTCC |

TABLE 15-continued

SUMMARY OF SEQUENCE LISTING

| SEQ ID | Description | Sequence |
|---|---|---|
| | | CTGATCTATGCTGCATCCAGTTTGCAAAGTGGGGTCCCATCAAGGT
TCAGCGGCAGTGGATCTGGGACAGATTTCACTCTCACCATCAGCAG
CCTGCAGCCTGAAGATTTTGCAACTTATTACTGCCAACAGTATAAT
AGTTACCCTCCGACGTTCGGCCAAGGGACCAAGGTGGAAATCAAA |
| 184 | 14E3 (full length wild-type heavy chain) nucleotide sequence The sequence encoding the constant region is underlined | CAGGTGCAGCTACAGCAGTGGGGCGCAGGACTGTTGAAGCCTTCGG
AGACCCTGTCCCTCACCTGCGCTGTCTATGGTGGGTCCTTCAGTGG
TTACTACTGGAGCTGGATCCGCCAGCCCCCAGGGAAGGGGCTGGAG
TGGATTGGAGAAATCAATCATAGTGGAAACACCTACTACAACCCGT
CCCTCAAGAGTCGCGTCACCATATCAGTAGACACGTCCAAGAACCA
GTTATCCCTGAAGCTGAGCTCTGTGACCGCCGCGGACACGGCTGTG
TATTACTGTGCGAGATTTGGGAGTAATGATGCTTTTGATATCTGGG
GCCAAGGGACAATGGTCACCGTCTCTTCA<u>GCCTCCACCAAGGGCCC
ATCGGTCTTCCCCCTGGCACCCTCCTCCAAGAGCACCTCTGGGGGC
ACAGCGGCCCTGGGCTGCCTGGTCAAGGACTACTTCCCCGAACCGG
TGACGGTGTCGTGGAACTCAGGCGCCCTGACCAGCGGCGTGCACAC
CTTCCCGGCTGTCCTACAGTCCTCAGGACTCTACTCCCTCAGCAGC
GTGGTGACCGTGCCCTCCAGCAGCTTGGGCACCCAGACCTACATCT
GCAACGTGAATCACAAGCCCAGCAACACCAAGGTGGACAAGAGAGT
TGAGCCCAAATCTTGTGACAAAACTCACACATGCCCACCGTGCCCA
GCACCTGAACTCCTGGGGGGACCGTCAGTCTTCCTCTTCCCCCCAA
AACCCAAGGACACCCTCATGATCTCCCGGACCCCTGAGGTCACATG
CGTGGTGGTGGACGTGAGCCACGAAGACCCTGAGGTCAAGTTCAAC
TGGTACGTGGACGGCGTGGAGGTGCATAATGCCAAGACAAAGCCGC
GGGAGGAGCAGTACAACAGCACGTACCGTGTGGTCAGCGTCCTCAC
CGTCCTGCACCAGGACTGGCTGAATGGCAAGGAGTACAAGTGCAAG
GTCTCCAACAAAGCCCTCCCAGCCCCCATCGAGAAAACCATCTCCA
AAGCCAAAGGGCAGCCCCGAGAACCACAGGTGTACACCCTGCCCCC
ATCCCGGGATGAGCTGACCAAGAACCAGGTCAGCCTGACCTGCCTG
GTCAAAGGCTTCTATCCCAGCGACATCGCCGTGGAGTGGGAGAGCA
ATGGGCAGCCGGAGAACAACTACAAGACCACGCCTCCCGTGCTGGA
CTCCGACGGCTCCTTCTTCCTCTACAGCAAGCTCACCGTGGACAAG
AGCAGGTGGCAGCAGGGGAACGTCTTCTCATGCTCCGTGATGCATG
AGGCTCTGCACAACCACTACACGCAGAAGAGCCTCTCCCTGTCTCC
GGGTAAA</u> |
| 185 | 14E3 (full length wild-type light chain) nucleotide sequence The sequence encoding the constant region is underlined | GACATCCAGATGACCCAGTCTCCATCCTCACTGTCTGCATCTGTAG
GAGACAGAGTCACCATCACTTGTCGGGCGAGTCAGGGTATTAGCAG
CTGGTTAGCCTGGTATCAGCAGAAACCAGAGAAAGCCCCTAAGTCC
CTGATCTATGCTGCATCCAGTTTGCAAAGTGGGGTCCCATCAAGGT
TCAGCGGCAGTGGATCTGGGACAGATTTCACTCTCACCATCAGCAG
CCTGCAGCCTGAAGATTTTGCAACTTATTACTGCCAACAGTATAAT
AGTTACCCTCCGACGTTCGGCCAAGGGACCAAGGTGGAAATCAAA<u>C
GAACTGTGGCTGCACCATCTGTCTTCATCTTCCCGCCATCTGATGA
GCAGTTGAAATCTGGAACTGCCTCTGTTGTGTGCCTGCTGAATAAC
TTCTATCCCAGAGAGGCCAAAGTACAGTGGAAGGTGGATAACGCCC
TCCAATCGGGTAACTCCCAGGAGAGTGTCACAGAGCAGGACAGCAA
GGACAGCACCTACAGCCTCAGCAGCACCCTGACGCTGAGCAAAGCA
GACTACGAGAAACACAAAGTCTACGCCTGCGAAGTCACCCATCAGG
GCCTGAGCTCGCCCGTCACAAAGAGCTTCAACAGGGGAGAGTGT</u> |
| 186 | 19H8 (VH) nucleotide sequence | CAGGTGCAGCTGGTGGAGTCTGGGGGAGGCGTGGTCCAGCCTGGGA
GGTCCCTGAGACTCTCCTGTGCAGCGTCTGGATTCACCTTCAGTAA
CTATGGCATGCACTGGGTCCGCCAGGCTCCAGGCAAGGGGCTGGAG
TGGATGGCAGTTATATGGTATGGTGGAAGTAATAAATTCTATGCAG
ACTCCGTGAAGGGCCGATTCACCATCTCCAGAGACAATTCCAAGAA
CTCGCTGTCTCTGCAAATGAACAGCCTGAGAGCCGAGGACACGGCT
GTGTATTACTGTGCGAGAGGGGGGCTATGGTTCGGGGAGTCTACT
ACTACGGTATGGACGTCTGGGGCCAAGGGACCACGGTCAC
CGTCTCCTCA |
| 187 | 19H8 (VL1) nucleotide sequence | GCCATCCAGTTGACCCAGTCTCCATCCTCCCTGTCTGCATCTGTAG
GAGACAGAGTCACCATCACTTGCCGGGCAAGTCAGGGCATTAGCAG
TGCTTTAGCCTGGTATCAGCAGAAACCAGGGAAAGCTCCTAAGTTC
CTGATCTATGATGCCTCCAGTTTGGAAAGTGGGGTCCCATCAAGGT
TCAGCGGCAGTGGATCTGGGACAGATTTCACTCTCACCATCAGCAG
CCTGCAGCCTGAAGATTTTGCAACTTATTACTGTCAACAGTTTAAT
AGTTACCCTCAGACGTTCGGCCAAGGGACCAAGGTGGAAATCAAA |

US 11,213,586 B2

TABLE 15-continued

SUMMARY OF SEQUENCE LISTING

| SEQ ID | Description | Sequence |
|---|---|---|
| 188 | 19H8 (VL2) nucleotide sequence | GAAATTGTGTTGACACAGTCTCCAGCCACCCTGTCTTTGTCTCCAG GGGAAAGAGCCACCCTCTCCTGCAGGGCCAGTCAGAGTGTTAGCAG CTACTTAGCCTGGTACCAACAGAAACCTGGCCAGGCTCCCAGGCTC CTCATCTATGATGCATCCAACAGGGCCACTGGCATCCCAGCCAGGT TCAGTGGCAGTGGGTCTGGGACAGACTTCACTCTCACCATCAGCAG CCTAGAGCCTGAAGATTTTGCAGTTTATTACTGTCAGCAGCGTAGC AACTGGCCGCTCACTTTCGGCGGAGGGACCAAGGTGGAGATCAAA |
| 189 | 19H8 (full length wild-type heavy chain) nucleotide sequence The sequence encoding the constant region is underlined | CAGGTGCAGCTGGTGGAGTCTGGGGGAGGCGTGGTCCAGCCTGGGA GGTCCCTGAGACTCTCCTGTGCAGCGTCTGGATTCACCTTCAGTAA CTATGGCATGCACTGGGTCCGCCAGGCTCCAGGCAAGGGGCTGGAG TGGATGGCAGTTATATGGTATGGTGGAAGTAATAAATTCTATGCAG ACTCCGTGAAGGGCCGATTCACCATCTCCAGAGACAATTCCAAGAA CTCGCTGTCTCTGCAAATGAACAGCCTGAGAGCCGAGGACACGGCT GTGTATTACTGTGCGAGAGGGGGGCTATGGTTCGGGGAGTCTACT ACTACGGTATGGACGTCTGGGGCCAAGGGACCACGGTCACCGTCTC CTCAGCCTCCACCAAGGGCCCATCGGTCTTCCCCCTGGCGCCCTGC TCCAGGAGCACCTCCGAGAGCACAGCGGCCCTGGGCTGCCTGGTCA AGGACTACTTCCCCGAACCGGTGACGGTGTCGTGGAACTCAGGCGC TCTGACCAGCGGCGTGCACACCTTCCCAGCTGTCCTACAGTCCTCA GGACTCTACTCCCTCAGCAGCGTGGTGACCGTGCCCTCCAGCAACT TCGGCACCCAGACCTACACCTGCAACGTAGATCACAAGCCCAGCAA CACCAAGGTGGACAAGACAGTTGAGCGCAAATGTTGTGTCGAGTGC CCACCGTGCCCAGCACCACCTGTGGCAGGACCGTCAGTCTTCCTCT TCCCCCCAAAACCCAAGGACACCCTCATGATCTCCCGGACCCCTGA GGTCACGTGCGTGGTGGTGGACGTGAGCCACGAAGACCCCGAGGTC CAGTTCAACTGGTACGTGGACGGCGTGGAGGTGCATAATGCCAAGA CAAAGCCACGGGAGGAGCAGTTCAACAGCACGTTCCGTGTGGTCAG CGTCCTCACCGTTGTGCACCAGGACTGGCTGAACGGCAAGGAGTAC AAGTGCAAGGTCTCCAACAAAGGCCTCCCAGCCCCCATCGAGAAAA CCATCTCCAAAACCAAAGGGCAGCCCCGAGAACCACAGGTGTACAC CCTGCCCCCATCCCGGGAGGAGATGACCAAGAACCAGGTCAGCCTG ACCTGCCTGGTCAAAGGCTTCTACCCCAGCGACATCGCCGTGGAGT GGGAGAGCAATGGGCAGCCGGAGAACAACTACAAGACCACACCTCC CATGCTGGACTCCGACGGCTCCTTCTTCCTCTACAGCAAGCTCACC GTGGACAAGAGCAGGTGGCAGCAGGGGAACGTCTTCTCATGCTCCG TGATGCATGAGGCTCTGCACAACCACTACACGCAGAAGAGCCTCTC CCTGTCTCCGGGTAAA |
| 190 | 19H8 L1 (full length wild-type light chain) nucleotide sequence The sequence encoding the constant region is underlined | GCCATCCAGTTGACCCAGTCTCCATCCTCCCTGTCTGCATCTGTAG GAGACAGAGTCACCATCACTTGCCGGGCAAGTCAGGGCATTAGCAG TGCTTTAGCCTGGTATCAGCAGAAACAGGGAAAGCTCCTAAGTTC CTGATCTATGATGCCTCCAGTTTGGAAAGTGGGGTCCCATCAAGGT TCAGCGGCAGTGGATCTGGGACAGATTTCACTCTCACCATCAGCAG CCTGCAGCCTGAAGATTTTGCAACTTATTACTGTCAACAGTTTAAT AGTTACCCTCAGACGTTCGGCCAAGGGACCAAGGTGGAAATCAAA<u>C GAACTGTGGCTGCACCATCTGTCTTCATCTTCCCGCCATCTGATGA GCAGTTGAAATCTGGAACTGCCTCTGTTGTGTGCCTGCTGAATAAC TTCTATCCCAGAGAGGCCAAAGTACAGTGGAAGGTGGATAACGCCC TCCAATCGGGTAACTCCCAGGAGAGTGTCACAGAGCAGGACAGCAA GGACAGCACCTACAGCCTCAGCAGCACCCTGACGCTGAGCAAAGCA GACTACGAGAAACACAAAGTCTACGCCTGCGAAGTCACCCATCAGG GCCTGAGCTCGCCCGTCACAAAGAGCTTCAACAGGGGAGAGTGT</u> |
| 191 | 19H8 L2 (full length wild-type light chain) nucleotide sequence The sequence encoding the constant region is underlined | GAAATTGTGTTGACACAGTCTCCAGCCACCCTGTCTTTGTCTCCAG GGGAAAGAGCCACCCTCTCCTGCAGGGCCAGTCAGAGTGTTAGCAG CTACTTAGCCTGGTACCAACAGAAACCTGGCCAGGCTCCCAGGCTC CTCATCTATGATGCATCCAACAGGGCCACTGGCATCCCAGCCAGGT TCAGTGGCAGTGGGTCTGGGACAGACTTCACTCTCACCATCAGCAG CCTAGAGCCTGAAGATTTTGCAGTTTATTACTGTCAGCAGCGTAGC AACTGGCCGCTCACTTTCGGCGGAGGGACCAAGGTGGAGATCAAA<u>C GAACTGTGGCTGCACCATCTGTCTTCATCTTCCCGCCATCTGATGA GCAGTTGAAATCTGGAACTGCCTCTGTTGTGTGCCTGCTGAATAAC TTCTATCCCAGAGAGGCCAAAGTACAGTGGAAGGTGGATAACGCCC TCCAATCGGGTAACTCCCAGGAGAGTGTCACAGAGCAGGACAGCAA GGACAGCACCTACAGCCTCAGCAGCACCCTGACGCTGAGCAAAGCA GACTACGAGAAACACAAAGTCTACGCCTGCGAAGTCACCCATCAGG GCCTGAGCTCGCCCGTCACAAAGAGCTTCAACAGGGGAGAGTGT</u> |
| 192 | VH 3-33 (28F3, 18E10, 19D3, 2G6, 8A6, 19H8) | QVQLVESGGGVVQPGRSLRLSCAASGFTFSSYGMHWVRQAPGKGLE WVAVIWYDGSNKYYADSVKGRFTISRDNSKNTLYLQMNSLRAEDTA VYYCAR |
| 193 | VH 3-10 (28F3, 8A6) | MVRG |

TABLE 15-continued

SUMMARY OF SEQUENCE LISTING

| SEQ ID | Description | Sequence |
|---|---|---|
| 194 | VH 3-10 (9G7) | YYYG |
| 195 | VH 3-10 (19H8) | YYY |
| 196 | VH JH6 (28F3, 19H8) | YYYGMDVWGQGTTVTVSS |
| 197 | VH JH6 (18E10, 2G6, 8A6) | YYGMDVWGQGTTVTVSS |
| 198 | VH JH6 (19D3, 9G7) | YYYYYGMDVWGQGTTVTVSS |
| 199 | VH 6-19 (18E10) | IAVA |
| 200 | VH 3-16 (19D3) | DY |
| 201 | VH 4-34 (3C3, 14E3) | QVQLQQWGAGLLKPSETLSLTCAVYGGSFSGYYWSWIRQPPGKGLEWIGEINHSGSTNYNPSLKSRVTISVDTSKNQFSLKLSSVTAADTAVYYCAR |
| 202 | VH JH3 (3C3, 14E3) | DAFDIWGQGTMVTVSS |
| 203 | VH 3-15 (9G7) | EVQLVESGGGLVKPGGSLRLSCAASGFTFSNAWMSWVRQAPGKGLEWVGRIKSKTDGGTTDYAAPVKGRFTISRDDSKNTLYLQMNSLKTEDTAVYYCTT |
| 204 | VL L18 (28F3, 8A6, 19H8VK1) | AIQLTQSPSSLSASVGDRVTITCRASQGISSALAWYQQKPGKAPKLLIYDASSLESGVPSRFSGSGSGTDFTLTISSLQPEDFATYYCQQFNNY |
| 205 | VL JK2 (28F3, 18E10, 19D3, 3C3VK1, 8A6, 2G6) | YTFGQGTKLEIK |
| 206 | VL JK2 (3C3VK2) | TFGQGTKLEIK |
| 207 | VL L15 (18E10, 19D3, 3C3VK1, 2G6, 14E3) | DIQMTQSPSSLSASVGDRVTITCRASQGISSWLAWYQQKPEKAPKSLIYAASSLQSGVPSRFSGSGSGTDFTLTISSLQPEDFATYYCQQYNSY |
| 208 | VL L20 (3C3VK2) | EIVLTQSPATLSLSPGERATLSCRASQGVSSYLAWYQQKPGQAPRLLIYDASNRATGIPARFSGSGPGTDFTLTISSLEPEDFAVYYCQQRSNW |
| 209 | VL A27 (9G7VK1, 9G7VK2) | EIVLTQSPGTLSLSPGERATLSCRASQSVSSSYLAWYQQKPGQAPRLLIYGASSRATGIPDRFSGSGSGTDFTLTISRLEPEDFAVYYCQQYGSS |
| 210 | VL JK1 (9G7VK1) | WTFGQGTKVEIK |
| 211 | VL JK1 (14E3, 19H8VK1) | TFGQGTKVEIK |
| 212 | VL JK5 (9G7VK2) | ITFGQGTRLEIK |
| 213 | VL L6 (19H8VK2) | EIVLTQSPATLSLSPGERATLSCRASQSVSSYLAWYQQKPGQAPRLLIYDASNRATGIPARFSGSGSGTDFTLTISSLEPEDFAVYYCQQRSNW |
| 214 | VL JK4 (19H8VK2) | LTFGGGTKVEIK |
| 215 | GITR epitope | QRPTGGPGCGPGRLLLGTGTDARCCRVHTTRCCRDYPGE |
| 216 | GITR epitope | QRPTGGPGCGPGRLLLGTGT |
| 217 | GITR epitope (region 1) | PTGGPGCGPGRLLLGTGT |
| 218 | GITR epitope (region 2) | CRDYPGEE |
| 219 | Peptide linker | PVGVV |
| 220 | Heavy chain C-terminus | LSPGK |

TABLE 15-continued

SUMMARY OF SEQUENCE LISTING

| SEQ ID | Description | Sequence |
|---|---|---|
| 221 | G2 constant region | ASTKGPSVFPLAPCSRSTSESTAALGCLVKDYFPEPVTVSWNSGAL TSGVHTFPAVLQSSGLYSLSSVVTVPSSNFGTQTYTCNVDHKPSNT KVDKTVERKCCVECPPCPAPPVAGPSVFLFPPKPKDTLMISRTPEV TCVVVDVSHEDPEVQFNWYVDGVEVHNAKTKPREEQFNSTFRVVSV LTVVHQDWLNGKEYKCKVSNKGLPAPIEKTISKTKGQREPQVYTL PPSREEMTKNQVSLTCLVKGFYPSDIAVEWESNGQPENNYKTTPPM LDSDGSFFLYSKLTVDKSRWQQGNVFSCSVMHEALHNHYTQKSLSL SPG |
| 222 | G2(C219S) constant region | ASTKGPSVFPLAPCSRSTSESTAALGCLVKDYFPEPVTVSWNSGAL TSGVHTFPAVLQSSGLYSLSSVVTVPSSNFGTQTYTCNVDHKPSNT KVDKTVERKSCVECPPCPAPPVAGPSVFLFPPKPKDTLMISRTPEV TCVVVDVSHEDPEVQFNWYVDGVEVHNAKTKPREEQFNSTFRVVSV LTVVHQDWLNGKEYKCKVSNKGLPAPIEKTISKTKGQREPQVYTL PPSREEMTKNQVSLTCLVKGFYPSDIAVEWESNGQPENNYKTTPPM LDSDGSFFLYSKLTVDKSRWQQGNVFSCSVMHEALHNHYTQKSLSL SPG |
| 223 | G2.g1 modified constant region | ASTKGPSVFPLAPCSRSTSESTAALGCLVKDYFPEPVTVSWNSGAL TSGVHTFPAVLQSSGLYSLSSVVTVPSSNFGTQTYTCNVDHKPSNT KVDKTVERKCCVECPPCPAPELLGGPSVFLFPPKPKDTLMISRTPE VTCVVVDVSHEDPEVKFNWYVDGVEVHNAKTKPREEQYNSTYRVVS VLTVLHQDWLNGKEYKCKVSNKALPAPIEKTISKAKGQPREPQVYT LPPSREEMTKNQVSLTCLVKGFYPSDIAVEWESNGQPENNYKTTPP VLDSDGSFFLYSKLTVDKSRWQQGNVFSCSVMHEALHNHYTQKSLS LSPG |
| 224 | G2.g1.1 modified constant region | ASTKGPSVFPLAPCSRSTSESTAALGCLVKDYFPEPVTVSWNSGAL TSGVHTFPAVLQSSGLYSLSSVVTVPSSNFGTQTYTCNVDHKPSNT KVDKTVERKCCVECPPCPAPPVAGPSVFLFPPKPKDTLMISRTPEV TCVVVDVSHEDPEVKFNWYVDGVEVHNAKTKPREEQYNSTYRVVSV LTVLHQDWLNGKEYKCKVSNKALPSSIEKTISKAKGQPREPQVYTL PPSREEMTKNQVSLTCLVKGFYPSDIAVEWESNGQPENNYKTTPPV LDSDGSFFLYSKLTVDKSRWQQGNVFSCSVMHEALHNHYTQKSLSL SPG |
| 225 | G2(C219S).g1 modified constant region | ASTKGPSVFPLAPCSRSTSESTAALGCLVKDYFPEPVTVSWNSGAL TSGVHTFPAVLQSSGLYSLSSVVTVPSSNFGTQTYTCNVDHKPSNT KVDKTVERKSCVECPPCPAPELLGGPSVFLFPPKPKDTLMISRTPE VTCVVVDVSHEDPEVKFNWYVDGVEVHNAKTKPREEQYNSTYRVVS VLTVLHQDWLNGKEYKCKVSNKALPAPIEKTISKAKGQPREPQVYT LPPSREEMTKNQVSLTCLVKGFYPSDIAVEWESNGQPENNYKTTPP VLDSDGSFFLYSKLTVDKSRWQQGNVFSCSVMHEALHNHYTQKSLS LSPG |
| 226 | G2(C219S).g1.1 modified constant region | ASTKGPSVFPLAPCSRSTSESTAALGCLVKDYFPEPVTVSWNSGAL TSGVHTFPAVLQSSGLYSLSSVVTVPSSNFGTQTYTCNVDHKPSNT KVDKTVERKSCVECPPCPAPPVAGPSVFLFPPKPKDTLMISRTPEV TCVVVDVSHEDPEVKFNWYVDGVEVHNAKTKPREEQYNSTYRVVSV LTVLHQDWLNGKEYKCKVSNKALPSSIEKTISKAKGQPREPQVYTL PPSREEMTKNQVSLTCLVKGFYPSDIAVEWESNGQPENNYKTTPPV LDSDGSFFLYSKLTVDKSRWQQGNVFSCSVMHEALHNHYTQKSLSL SPG |
| 15 | 28F3 (VH + G2) or 28F3-IgG2 | SEQ ID NO: 15 |
| 227 | 28F3 (VH + G2(C219S)) or 28F3-IgG2-C219S | QVQLVESGGGVVQPGRSLRLSCAASGFTFSSYGMHWVRQAPGKGLE WVAVIWYEGSNKYYADSVKGRFTISRDNSKNTLYLQMNSLRAEDTA VYYCARGGSMVRGDYYYGMDVWGQGTTVTVSSASTKGPSVFPLAPC SRSTSESTAALGCLVKDYFPEPVTVSWNSGALTSGVHTFPAVLQSS GLYSLSSVVTVPSSNFGTQTYTCNVDHKPSNTKVDKTVERKSCVEC PPCPAPPVAGPSVFLFPPKPKDTLMISRTPEVTCVVVDVSHEDPEV QFNWYVDGVEVHNAKTKPREEQFNSTFRVVSVLTVVHQDWLNGKEY KCKVSNKGLPAPIEKTISKTKGQPREPQVYTLPPSREEMTKNQVSL TCLVKGFYPSDIAVEWESNGQPENNYKTTPPMLDSDGSFFLYSKLT VDKSRWQQGNVFSCSVMHEALHNHYTQKSLSLSPG |
| 228 | 28F3 (VH + G2.g1) or 28F3-IgG2-IgG1 | QVQLVESGGGVVQPGRSLRLSCAASGFTFSSYGMHWVRQAPGKGLE WVAVIWYEGSNKYYADSVKGRFTISRDNSKNTLYLQMNSLRAEDTA VYYCARGGSMVRGDYYYGMDVWGQGTTVTVSSASTKGPSVFPLAPC SRSTSESTAALGCLVKDYFPEPVTVSWNSGALTSGVHTFPAVLQSS GLYSLSSVVTVPSSNFGTQTYTCNVDHKPSNTKVDKTVERKCCVEC PPCPAPELLGGPSVFLFPPKPKDTLMISRTPEVTCVVVDVSHEDPE VKFNWYVDGVEVHNAKTKPREEQYNSTYRVVSVLTVLHQDWLNGKE |

TABLE 15-continued

SUMMARY OF SEQUENCE LISTING

| SEQ ID | Description | Sequence |
|---|---|---|
| | | YKCKVSNKALPAPIEKTISKAKGQPREPQVYTLPPSREEMTKNQVS<br>LTCLVKGFYPSDIAVEWESNGQPENNYKTTPPVLDSDGSFFLYSKL<br>TVDKSRWQQGNVFSCSVMHEALHNHYTQKSLSLSPG |
| 229 | 28F3 (VH + G2.g1.1) or<br>28F3-IgG2-IgG1.1 | QVQLVESGGGVVQPGRSLRLSCAASGFTFSSYGMHWVRQAPGKGLE<br>WVAVIWYEGSNKYYADSVKGRFTISRDNSKNTLYLQMNSLRAEDTA<br>VYYCARGGSMVRGDYYYGMDVWGQGTTVTVSSASTKGPSVFPLAPC<br>SRSTSESTAALGCLVKDYFPEPVTVSWNSGALTSGVHTFPAVLQSS<br>GLYSLSSVVTVPSSNFGTQTYTCNVDHKPSNTKVDKTVERKCCVEC<br>PPCPAPPVAGPSVFLFPPKPKDTLMISRTPEVTCVVVDVSHEDPEV<br>KFNWYVDGVEVHNAKTKPREEQYNSTYRVVSVLTVLHQDWLNGKEY<br>KCKVSNKALPSSIEKTISKAKGQPREPQVYTLPPSREEMTKNQVSL<br>TCLVKGFYPSDIAVEWESNGQPENNYKTTPPVLDSDGSFFLYSKLT<br>VDKSRWQQGNVFSCSVMHEALHNHYTQKSLSLSPG |
| 230 | 28F3 (VH + G2(C219S).g1) or<br>28F3-IgG2-C219S-IgG1 | QVQLVESGGGVVQPGRSLRLSCAASGFTFSSYGMHWVRQAPGKGLE<br>WVAVIWYEGSNKYYADSVKGRFTISRDNSKNTLYLQMNSLRAEDTA<br>VYYCARGGSMVRGDYYYGMDVWGQGTTVTVSSASTKGPSVFPLAPC<br>SRSTSESTAALGCLVKDYFPEPVTVSWNSGALTSGVHTFPAVLQSS<br>GLYSLSSVVTVPSSNFGTQTYTCNVDHKPSNTKVDKTVERKSCVEC<br>PPCPAPELLGGPSVFLFPPKPKDTLMISRTPEVTCVVVDVSHEDPE<br>VKFNWYVDGVEVHNAKTKPREEQYNSTYRVVSVLTVLHQDWLNGKE<br>YKCKVSNKALPAPIEKTISKAKGQPREPQVYTLPPSREEMTKNQVS<br>LTCLVKGFYPSDIAVEWESNGQPENNYKTTPPVLDSDGSFFLYSKL<br>TVDKSRWQQGNVFSCSVMHEALHNHYTQKSLSLSPG |
| 231 | 28F3 (VH + G2(C219S).g1.1) or<br>28F3-IgG2-C219S-IgG1.1 | QVQLVESGGGVVQPGRSLRLSCAASGFTFSSYGMHWVRQAPGKGLE<br>WVAVIWYEGSNKYYADSVKGRFTISRDNSKNTLYLQMNSLRAEDTA<br>VYYCARGGSMVRGDYYYGMDVWGQGTTVTVSSASTKGPSVFPLAPC<br>SRSTSESTAALGCLVKDYFPEPVTVSWNSGALTSGVHTFPAVLQSS<br>GLYSLSSVVTVPSSNFGTQTYTCNVDHKPSNTKVDKTVERKSCVEC<br>PPCPAPPVAGPSVFLFPPKPKDTLMISRTPEVTCVVVDVSHEDPEV<br>KFNWYVDGVEVHNAKTKPREEQYNSTYRVVSVLTVLHQDWLNGKEY<br>KCKVSNKALPSSIEKTISKAKGQPREPQVYTLPPSREEMTKNQVSL<br>TCLVKGFYPSDIAVEWESNGQPENNYKTTPPVLDSDGSFFLYSKLT<br>VDKSRWQQGNVFSCSVMHEALHNHYTQKSLSLSPG |
| 28 | 19D3 (VH + G2) or<br>19D3-IgG2 | SEQ ID NO: 28 |
| 232 | 19D3 (VH + G2(C219S)) or<br>19D3-IgG2-C219S | QVQLVESGGGVVQPGRSLRLSCAASGFTFSSYGFHWVRQAPGKGLE<br>WVAVIWYAGSNKFYADSVKGRFTISRDNSKNTLYLQMNSLRAEDTA<br>VYYCARGGQLDYYYYVMDVWGQGTTVTVSSASTKGPSVFPLAPCS<br>RSTSESTAALGCLVKDYFPEPVTVSWNSGALTSGVHTFPAVLQSSG<br>LYSLSSVVTVPSSNFGTQTYTCNVDHKPSNTKVDKTVERKSCVECP<br>PCPAPPVAGPSVFLFPPKPKDTLMISRTPEVTCVVVDVSHEDPEVQ<br>FNWYVDGVEVHNAKTKPREEQFNSTFRVVSVLTVVHQDWLNGKEYK<br>CKVSNKGLPAPIEKTISKTKGQPREPQVYTLPPSREEMTKNQVSLT<br>CLVKGFYPSDIAVEWESNGQPENNYKTTPPMLDSDGSFFLYSKLTV<br>DKSRWQQGNVFSCSVMHEALHNHYTQKSLSLSPG |
| 233 | 19D3 (VH + G2.g1) or<br>19D3-IgG2-IgG1 | QVQLVESGGGVVQPGRSLRLSCAASGFTFSSYGFHWVRQAPGKGLE<br>WVAVIWYAGSNKFYADSVKGRFTISRDNSKNTLYLQMNSLRAEDTA<br>VYYCARGGQLDYYYYVMDVWGQGTTVTVSSASTKGPSVFPLAPCS<br>RSTSESTAALGCLVKDYFPEPVTVSWNSGALTSGVHTFPAVLQSSG<br>LYSLSSVVTVPSSNFGTQTYTCNVDHKPSNTKVDKTVERKCCVECP<br>PCPAPELLGGPSVFLFPPKPKDTLMISRTPEVTCVVVDVSHEDPEV<br>KFNWYVDGVEVHNAKTKPREEQYNSTYRVVSVLTVLHQDWLNGKEY<br>KCKVSNKALPAPIEKTISKAKGQPREPQVYTLPPSREEMTKNQVSL<br>TCLVKGFYPSDIAVEWESNGQPENNYKTTPPVLDSDGSFFLYSKLT<br>VDKSRWQQGNVFSCSVMHEALHNHYTQKSLSLSPG |
| 234 | 19D3 (VH + G2.g1.1) or<br>19D3-IgG2-IgG1.1 | QVQLVESGGGVVQPGRSLRLSCAASGFTFSSYGFHWVRQAPGKGLE<br>WVAVIWYAGSNKFYADSVKGRFTISRDNSKNTLYLQMNSLRAEDTA<br>VYYCARGGQLDYYYYVMDVWGQGTTVTVSSASTKGPSVFPLAPCS<br>RSTSESTAALGCLVKDYFPEPVTVSWNSGALTSGVHTFPAVLQSSG<br>LYSLSSVVTVPSSNFGTQTYTCNVDHKPSNTKVDKTVERKCCVECP<br>PCPAPPVAGPSVFLFPPKPKDTLMISRTPEVTCVVVDVSHEDPEVK<br>FNWYVDGVEVHNAKTKPREEQYNSTYRVVSVLTVLHQDWLNGKEYK<br>CKVSNKALPSSIEKTISKAKGQPREPQVYTLPPSREEMTKNQVSLT<br>CLVKGFYPSDIAVEWESNGQPENNYKTTPPVLDSDGSFFLYSKLTV<br>DKSRWQQGNVFSCSVMHEALHNHYTQKSLSLSPG |

TABLE 15-continued

SUMMARY OF SEQUENCE LISTING

| SEQ ID | Description | Sequence |
|---|---|---|
| 235 | 19D3 (VH + G2(C219S).g1) or 19D3-IgG2-C219S-IgG1 | QVQLVESGGGVVQPGRSLRLSCAASGFTFSSYGFHWVRQAPGKGLE WVAVIWYAGSNKFYADSVKGRFTISRDNSKNTLYLQMNSLRAEDTA VYYCARGGQLDYYYYYVMDVWGQGTTVTVSSASTKGPSVFPLAPCS RSTSESTAALGCLVKDYFPEPVTVSWNSGALTSGVHTFPAVLQSSG LYSLSSVVTVPSSNFGTQTYTCNVDHKPSNTKVDKTVERKSCVECP PCPAPELLGGPSVFLFPPKPKDTLMISRTPEVTCVVVDVSHEDPEV KFNWYVDGVEVHNAKTKPREEQYNSTYRVVSVLTVLHQDWLNGKEY KCKVSNKALPAPIEKTISKAKGQPREPQVYTLPPSREEMTKNQVSL TCLVKGFYPSDIAVEWESNGQPENNYKTTPPVLDSDGSFFLYSKLT VDKSRWQQGNVFSCSVMHEALHNHYTQKSLSLSPG |
| 236 | 19D3 (VH + G2(C219S).g1.1) or 19D3-IgG2-C219S-IgG1.1 | QVQLVESGGGVVQPGRSLRLSCAASGFTFSSYGFHWVRQAPGKGLE WVAVIWYAGSNKFYADSVKGRFTISRDNSKNTLYLQMNSLRAEDTA VYYCARGGQLDYYYYYVMDVWGQGTTVTVSSASTKGPSVFPLAPCS RSTSESTAALGCLVKDYFPEPVTVSWNSGALTSGVHTFPAVLQSSG LYSLSSVVTVPSSNFGTQTYTCNVDHKPSNTKVDKTVERKCCVECP PCPAPPVAGPSVFLFPPKPKDTLMISRTPEVTCVVVDVSHEDPEVK FNWYVDGVEVHNAKTKPREEQYNSTYRVVSVLTVLHQDWLNGKEYK CKVSNKALPSSIEKTISKAKGQPREPQVYTLPPSREEMTKNQVSLT CLVKGFYPSDIAVEWESNGQPENNYKTTPPVLDSDGSFFLYSKLTV DKSRWQQGNVFSCSVMHEALHNHYTQKSLSLSPG |
| 41 | 18E10 (VH + G2) or 18E10-IgG2 | SEQ ID NO: 41 |
| 237 | 18E10 (VH + G2(C219S)) or 18E10-IgG2-C219S | QVQLVESGGGVVQPGRSLRLSCAASGFTFSSYGMHWVRQAPGKGLE WVAVIWYAGSNKYYADSVKGRFTISRDNSKNTLYLQMNSLRAEDTA VYYCARGRIAVAFYYSMDVWGQGTTVTVSSASTKGPSVFPLAPCS RSTSESTAALGCLVKDYFPEPVTVSWNSGALTSGVHTFPAVLQSSG LYSLSSVVTVPSSNFGTQTYTCNVDHKPSNTKVDKTVERKSCVECP PCPAPPVAGPSVFLFPPKPKDTLMISRTPEVTCVVVDVSHEDPEVQ FNWYVDGVEVHNAKTKPREEQFNSTFRVVSVLTVVHQDWLNGKEYK CKVSNKGLPAPIEKTISKTKGQPREPQVYTLPPSREEMTKNQVSLT CLVKGFYPSDIAVEWESNGQPENNYKTTPPMLDSDGSFFLYSKLTV DKSRWQQGNVFSCSVMHEALHNHYTQKSLSLSPG |
| 238 | 18E10 (VH + G2.g1) or 18E10-IgG2-IgG1 | QVQLVESGGGVVQPGRSLRLSCAASGFTFSSYGMHWVRQAPGKGLE WVAVIWYAGSNKYYADSVKGRFTISRDNSKNTLYLQMNSLRAEDTA VYYCARGRIAVAFYYSMDVWGQGTTVTVSSASTKGPSVFPLAPCS RSTSESTAALGCLVKDYFPEPVTVSWNSGALTSGVHTFPAVLQSSG LYSLSSVVTVPSSNFGTQTYTCNVDHKPSNTKVDKTVERKCCVECP PCPAPELLGGPSVFLFPPKPKDTLMISRTPEVTCVVVDVSHEDPEV KFNWYVDGVEVHNAKTKPREEQYNSTYRVVSVLTVLHQDWLNGKEY KCKVSNKALPAPIEKTISKAKGQPREPQVYTLPPSREEMTKNQVSL TCLVKGFYPSDIAVEWESNGQPENNYKTTPPVLDSDGSFFLYSKLT VDKSRWQQGNVFSCSVMHEALHNHYTQKSLSLSPG |
| 239 | 18E10 (VH + G2.g1.1) or 18E10-IgG2-IgG1.1 | QVQLVESGGGVVQPGRSLRLSCAASGFTFSSYGMHWVRQAPGKGLE WVAVIWYAGSNKYYADSVKGRFTISRDNSKNTLYLQMNSLRAEDTA VYYCARGRIAVAFYYSMDVWGQGTTVTVSSASTKGPSVFPLAPCS RSTSESTAALGCLVKDYFPEPVTVSWNSGALTSGVHTFPAVLQSSG LYSLSSVVTVPSSNFGTQTYTCNVDHKPSNTKVDKTVERKCCVECP PCPAPPVAGPSVFLFPPKPKDTLMISRTPEVTCVVVDVSHEDPEVK FNWYVDGVEVHNAKTKPREEQYNSTYRVVSVLTVLHQDWLNGKEYK CKVSNKALPSSIEKTISKAKGQPREPQVYTLPPSREEMTKNQVSLT CLVKGFYPSDIAVEWESNGQPENNYKTTPPVLDSDGSFFLYSKLTV DKSRWQQGNVFSCSVMHEALHNHYTQKSLSLSPG |
| 240 | 18E10 (VH + G2(C219S).g1) or 18E10-IgG2-C219S-IgG1 | QVQLVESGGGVVQPGRSLRLSCAASGFTFSSYGMHWVRQAPGKGLE WVAVIWYAGSNKYYADSVKGRFTISRDNSKNTLYLQMNSLRAEDTA VYYCARGRIAVAFYYSMDVWGQGTTVTVSSASTKGPSVFPLAPCS RSTSESTAALGCLVKDYFPEPVTVSWNSGALTSGVHTFPAVLQSSG LYSLSSVVTVPSSNFGTQTYTCNVDHKPSNTKVDKTVERKSCVECP PCPAPELLGGPSVFLFPPKPKDTLMISRTPEVTCVVVDVSHEDPEV KFNWYVDGVEVHNAKTKPREEQYNSTYRVVSVLTVLHQDWLNGKEY KCKVSNKALPAPIEKTISKAKGQPREPQVYTLPPSREEMTKNQVSL TCLVKGFYPSDIAVEWESNGQPENNYKTTPPVLDSDGSFFLYSKLT VDKSRWQQGNVFSCSVMHEALHNHYTQKSLSLSPG |
| 241 | 18E10 (VH + G2(C219S).g1.1) or 18E10-IgG2-C219S-IgG1.1 | QVQLVESGGGVVQPGRSLRLSCAASGFTFSSYGMHWVRQAPGKGLE WVAVIWYAGSNKYYADSVKGRFTISRDNSKNTLYLQMNSLRAEDTA VYYCARGRIAVAFYYSMDVWGQGTTVTVSSASTKGPSVFPLAPCS RSTSESTAALGCLVKDYFPEPVTVSWNSGALTSGVHTFPAVLQSSG LYSLSSVVTVPSSNFGTQTYTCNVDHKPSNTKVDKTVERKSCVECP PCPAPPVAGPSVFLFPPKPKDTLMISRTPEVTCVVVDVSHEDPEVK |

TABLE 15-continued

SUMMARY OF SEQUENCE LISTING

| SEQ ID | Description | Sequence |
|---|---|---|
| | | FNWYVDGVEVHNAKTKPREEQYNSTYRVVSVLTVLHQDWLNGKEYK CKVSNKALPSSIEKTISKAKGQPREPQVYTLPPSREEMTKNQVSLT CLVKGFYPSDIAVEWESNGQPENNYKTTPPVLDSDGSFFLYSKLTV DKSRWQQGNVFSCSVMHEALHNHYTQKSLSLSPG |
| 242 | 3C3 (VH + G2) or 3C3-IgG2 | QVQLQQWGAGLLKPSETLSLTCAVYGGSFSGYYWTWIRQPPGKGLE WIGKINHSGNTNYNPSLKSRVTISVDTSKNQFSLKLSSVTAADTAV YYCARLGAFDAFDIWGQGTMVTVSSASTKGPSVFPLAPCSRSTSES TAALGCLVKDYFPEPVTVSWNSGALTSGVHTFPAVLQSSGLYSLSS VVTVPSSNFGTQTYTCNVDHKPSNTKVDKTVERKCCVECPPCPAPP VAGPSVFLFPPKPKDTLMISRTPEVTCVVVDVSHEDPEVQFNWYVD GVEVHNAKTKPREEQFNSTFRVVSVLTVVHQDWLNGKEYKCKVSNK GLPAPIEKTISKTKGQPREPQVYTLPPSREEMTKNQVSLTCLVKGF YPSDIAVEWESNGQPENNYKTTPPMLDSDGSFFLYSKLTVDKSRWQ QGNVFSCSVMHEALHNHYTQKSLSLSPG |
| 243 | 3C3 (VH + G2(C219S)) or 3C3-IgG2-C219S | QVQLQQWGAGLLKPSETLSLTCAVYGGSFSGYYWTWIRQPPGKGLE WIGKINHSGNTNYNPSLKSRVTISVDTSKNQFSLKLSSVTAADTAV YYCARLGAFDAFDIWGQGTMVTVSSASTKGPSVFPLAPCSRSTSES TAALGCLVKDYFPEPVTVSWNSGALTSGVHTFPAVLQSSGLYSLSS VVTVPSSNFGTQTYTCNVDHKPSNTKVDKTVERKSCVECPPCPAPP VAGPSVFLFPPKPKDTLMISRTPEVTCVVVDVSHEDPEVQFNWYVD GVEVHNAKTKPREEQFNSTFRVVSVLTVVHQDWLNGKEYKCKVSNK GLPAPIEKTISKTKGQPREPQVYTLPPSREEMTKNQVSLTCLVKGF YPSDIAVEWESNGQPENNYKTTPPMLDSDGSFFLYSKLTVDKSRWQ QGNVFSCSVMHEALHNHYTQKSLSLSPG |
| 244 | 3C3 (VH + G2.g1) or 3C3-IgG2-IgG1 | QVQLQQWGAGLLKPSETLSLTCAVYGGSFSGYYWTWIRQPPGKGLE WIGKINHSGNTNYNPSLKSRVTISVDTSKNQFSLKLSSVTAADTAV YYCARLGAFDAFDIWGQGTMVTVSSASTKGPSVFPLAPCSRSTSES TAALGCLVKDYFPEPVTVSWNSGALTSGVHTFPAVLQSSGLYSLSS VVTVPSSNFGTQTYTCNVDHKPSNTKVDKTVERKCCVECPPCPAPE LLGGPSVFLFPPKPKDTLMISRTPEVTCVVVDVSHEDPEVKFNWYV DGVEVHNAKTKPREEQYNSTYRVVSVLTVLHQDWLNGKEYKCKVSN KALPAPIEKTISKAKGQPREPQVYTLPPSREEMTKNQVSLTCLVKG FYPSDIAVEWESNGQPENNYKTTPPVLDSDGSFFLYSKLTVDKSRW QQGNVFSCSVMHEALHNHYTQKSLSLSPG |
| 245 | 3C3 (VH + G2.g1.1) or 3C3-IgG2-IgG1.1 | QVQLQQWGAGLLKPSETLSLTCAVYGGSFSGYYWTWIRQPPGKGLE WIGKINHSGNTNYNPSLKSRVTISVDTSKNQFSLKLSSVTAADTAV YYCARLGAFDAFDIWGQGTMVTVSSASTKGPSVFPLAPCSRSTSES TAALGCLVKDYFPEPVTVSWNSGALTSGVHTFPAVLQSSGLYSLSS VVTVPSSNFGTQTYTCNVDHKPSNTKVDKTVERKCCVECPPCPAPP VAGPSVFLFPPKPKDTLMISRTPEVTCVVVDVSHEDPEVKFNWYVD GVEVHNAKTKPREEQYNSTYRVVSVLTVLHQDWLNGKEYKCKVSNK ALPSSIEKTISKAKGQPREPQVYTLPPSREEMTKNQVSLTCLVKGF YPSDIAVEWESNGQPENNYKTTPPVLDSDGSFFLYSKLTVDKSRWQ QGNVFSCSVMHEALHNHYTQKSLSLSPG |
| 246 | 3C3 (VH + G2(C219S).g1) or 3C3-IgG2-C219S-IgG1 | QVQLQQWGAGLLKPSETLSLTCAVYGGSFSGYYWTWIRQPPGKGLE WIGKINHSGNTNYNPSLKSRVTISVDTSKNQFSLKLSSVTAADTAV YYCARLGAFDAFDIWGQGTMVTVSSASTKGPSVFPLAPCSRSTSES TAALGCLVKDYFPEPVTVSWNSGALTSGVHTFPAVLQSSGLYSLSS VVTVPSSNFGTQTYTCNVDHKPSNTKVDKTVERKSCVECPPCPAPE LLGGPSVFLFPPKPKDTLMISRTPEVTCVVVDVSHEDPEVKFNWYV DGVEVHNAKTKPREEQYNSTYRVVSVLTVLHQDWLNGKEYKCKVSN KALPAPIEKTISKAKGQPREPQVYTLPPSREEMTKNQVSLTCLVKG FYPSDIAVEWESNGQPENNYKTTPPVLDSDGSFFLYSKLTVDKSRW QQGNVFSCSVMHEALHNHYTQKSLSLSPG |
| 247 | 3C3 (VH + G2(C219S).g1.1) or 3C3-IgG2-C219S-IgG1.1 | QVQLQQWGAGLLKPSETLSLTCAVYGGSFSGYYWTWIRQPPGKGLE WIGKINHSGNTNYNPSLKSRVTISVDTSKNQFSLKLSSVTAADTAV YYCARLGAFDAFDIWGQGTMVTVSSASTKGPSVFPLAPCSRSTSES TAALGCLVKDYFPEPVTVSWNSGALTSGVHTFPAVLQSSGLYSLSS VVTVPSSNFGTQTYTCNVDHKPSNTKVDKTVERKSCVECPPCPAPP VAGPSVFLFPPKPKDTLMISRTPEVTCVVVDVSHEDPEVKFNWYVD GVEVHNAKTKPREEQYNSTYRVVSVLTVLHQDWLNGKEYKCKVSNK ALPSSIEKTISKAKGQPREPQVYTLPPSREEMTKNQVSLTCLVKGF YPSDIAVEWESNGQPENNYKTTPPVLDSDGSFFLYSKLTVDKSRWQ QGNVFSCSVMHEALHNHYTQKSLSLSPG |
| 248 | 2G6 (VH + G2) or 2G6-IgG2 | QVQLVESGGGVVQPGGSLRLSCAASGFILSDYGMHWVRQAPGKGLE WVTVIWYDGSNKFYVDSVKGRFTISRDNSKNTLYLQMNSLRVEDTA VYYCARGGRLATGHFYYMDWGQGTTVTVSSASTKGPSVFPLAPC SRSTSESTAALGCLVKDYFPEPVTVSWNSGALTSGVHTFPAVLQSS |

TABLE 15-continued

SUMMARY OF SEQUENCE LISTING

| SEQ ID | Description | Sequence |
|---|---|---|
| | | GLYSLSSVVTVPSSNFGTQTYTCNVDHKPSNTKVDKTVERKCCVEC
PPCPAPPVAGPSVFLFPPKPKDTLMISRTPEVTCVVVDVSHEDPEV
QFNWYVDGVEVHNAKTKPREEQFNSTFRVVSVLTVVHQDWLNGKEY
KCKVSNKGLPAPIEKTISKTKGQPREPQVYTLPPSREEMTKNQVSL
TCLVKGFYPSDIAVEWESNGQPENNYKTTPPMLDSDGSFFLYSKLT
VDKSRWQQGNVFSCSVMHEALHNHYTQKSLSLSPG |
| 249 | 2G6 (VH + G2(C219S)) or 2G6-IgG2-C219S | QVQLVESGGGVVQPGGSLRLSCAASGFILSDYGMHWVRQAPGKGLE
WVTVIWYDGSNKFYVDSVKGRFTISRDNSKNTLYLQMNSLRVEDTA
VYYCARGGRLATGHFYYVMDVWGQGTTVTVSSASTKGPSVFPLAPC
SRSTSESTAALGCLVKDYFPEPVTVSWNSGALTSGVHTFPAVLQSS
GLYSLSSVVTVPSSNFGTQTYTCNVDHKPSNTKVDKTVERKSCVEC
PPCPAPPVAGPSVFLFPPKPKDTLMISRTPEVTCVVVDVSHEDPEV
QFNWYVDGVEVHNAKTKPREEQFNSTFRVVSVLTVVHQDWLNGKEY
KCKVSNKGLPAPIEKTISKTKGQPREPQVYTLPPSREEMTKNQVSL
TCLVKGFYPSDIAVEWESNGQPENNYKTTPPMLDSDGSFFLYSKLT
VDKSRWQQGNVFSCSVMHEALHNHYTQKSLSLSPG |
| 250 | 2G6 (VH + G2.g1) or 2G6-IgG2-IgG1 | QVQLVESGGGVVQPGGSLRLSCAASGFILSDYGMHWVRQAPGKGLE
WVTVIWYDGSNKFYVDSVKGRFTISRDNSKNTLYLQMNSLRVEDTA
VYYCARGGRLATGHFYYVMDVWGQGTTVTVSSASTKGPSVFPLAPC
SRSTSESTAALGCLVKDYFPEPVTVSWNSGALTSGVHTFPAVLQSS
GLYSLSSVVTVPSSNFGTQTYTCNVDHKPSNTKVDKTVERKCCVEC
PPCPAPELLGGPSVFLFPPKPKDTLMISRTPEVTCVVVDVSHEDPE
VKFNWYVDGVEVHNAKTKPREEQYNSTYRVVSVLTVLHQDWLNGKE
YKCKVSNKALPAPIEKTISKAKGQPREPQVYTLPPSREEMTKNQVS
LTCLVKGFYPSDIAVEWESNGQPENNYKTTPPVLDSDGSFFLYSKL
TVDKSRWQQGNVFSCSVMHEALHNHYTQKSLSLSPG |
| 251 | 2G6 (VH + G2.g1.1) or 2G6-IgG2-IgG1.1 | QVQLVESGGGVVQPGGSLRLSCAASGFILSDYGMHWVRQAPGKGLE
WVTVIWYDGSNKFYVDSVKGRFTISRDNSKNTLYLQMNSLRVEDTA
VYYCARGGRLATGHFYYVMDVWGQGTTVTVSSASTKGPSVFPLAPC
SRSTSESTAALGCLVKDYFPEPVTVSWNSGALTSGVHTFPAVLQSS
GLYSLSSVVTVPSSNFGTQTYTCNVDHKPSNTKVDKTVERKCCVEC
PPCPAPPVAGPSVFLFPPKPKDTLMISRTPEVTCVVVDVSHEDPEV
KFNWYVDGVEVHNAKTKPREEQYNSTYRVVSVLTVLHQDWLNGKEY
KCKVSNKALPSSIEKTISKAKGQPREPQVYTLPPSREEMTKNQVSL
TCLVKGFYPSDIAVEWESNGQPENNYKTTPPVLDSDGSFFLYSKLT
VDKSRWQQGNVFSCSVMHEALHNHYTQKSLSLSPG |
| 252 | 2G6 (VH + G2(C219S).g1) or 2G6-IgG2-C219S-IgG1 | QVQLVESGGGVVQPGGSLRLSCAASGFILSDYGMHWVRQAPGKGLE
WVTVIWYDGSNKFYVDSVKGRFTISRDNSKNTLYLQMNSLRVEDTA
VYYCARGGRLATGHFYYVMDVWGQGTTVTVSSASTKGPSVFPLAPC
SRSTSESTAALGCLVKDYFPEPVTVSWNSGALTSGVHTFPAVLQSS
GLYSLSSVVTVPSSNFGTQTYTCNVDHKPSNTKVDKTVERKSCVEC
PPCPAPELLGGPSVFLFPPKPKDTLMISRTPEVTCVVVDVSHEDPE
VKFNWYVDGVEVHNAKTKPREEQYNSTYRVVSVLTVLHQDWLNGKE
YKCKVSNKALPAPIEKTISKAKGQPREPQVYTLPPSREEMTKNQVS
LTCLVKGFYPSDIAVEWESNGQPENNYKTTPPVLDSDGSFFLYSKL
TVDKSRWQQGNVFSCSVMHEALHNHYTQKSLSLSPG |
| 253 | 2G6 (VH + G2(C219S).g1.1) or 2G6-IgG2-C219S-IgG1.1 | QVQLVESGGGVVQPGGSLRLSCAASGFILSDYGMHWVRQAPGKGLE
WVTVIWYDGSNKFYVDSVKGRFTISRDNSKNTLYLQMNSLRVEDTA
VYYCARGGRLATGHFYYVMDVWGQGTTVTVSSASTKGPSVFPLAPC
SRSTSESTAALGCLVKDYFPEPVTVSWNSGALTSGVHTFPAVLQSS
GLYSLSSVVTVPSSNFGTQTYTCNVDHKPSNTKVDKTVERKSCVEC
PPCPAPPVAGPSVFLFPPKPKDTLMISRTPEVTCVVVDVSHEDPEV
KFNWYVDGVEVHNAKTKPREEQYNSTYRVVSVLTVLHQDWLNGKEY
KCKVSNKALPSSIEKTISKAKGQPREPQVYTLPPSREEMTKNQVSL
TCLVKGFYPSDIAVEWESNGQPENNYKTTPPVLDSDGSFFLYSKLT
VDKSRWQQGNVFSCSVMHEALHNHYTQKSLSLSPG |
| 86 | 8A6 (VH + G2) or 8A6-IgG2 | SEQ ID NO: 86 |
| 254 | 8A6 (VH + G2(C219S)) or 8A6-IgG2-C219S | QVQLVESGGGVVQPGRSLRLSCTASGFTFSSYGMQWVRQAPGKGLE
WVAVIWYEGSNKYYADSVKGRFTISRENSKNTLYLQMNSLRAEDTA
VYYCARGGLMVRGLFYYGMDVWGQGTTVTVSSASTKGPSVFPLAPC
SRSTSESTAALGCLVKDYFPEPVTVSWNSGALTSGVHTFPAVLQSS
GLYSLSSVVTVPSSNFGTQTYTCNVDHKPSNTKVDKTVERKSCVEC
PPCPAPPVAGPSVFLFPPKPKDTLMISRTPEVTCVVVDVSHEDPEV
QFNWYVDGVEVHNAKTKPREEQFNSTFRVVSVLTVVHQDWLNGKEY
KCKVSNKGLPAPIEKTISKTKGQPREPQVYTLPPSREEMTKNQVSL
TCLVKGFYPSDIAVEWESNGQPENNYKTTPPMLDSDGSFFLYSKLT
VDKSRWQQGNVFSCSVMHEALHNHYTQKSLSLSPG |

TABLE 15-continued

SUMMARY OF SEQUENCE LISTING

| SEQ ID | Description | Sequence |
|---|---|---|
| 255 | 8A6 (VH + G2.g1) or 8A6-IgG2-IgG1 | QVQLVESGGGVVQPGRSLRLSCTASGFTFSSYGMQWVRQAPGKGLE WVAVIWYEGSNKYYADSVKGRFTISRENSKNTLYLQMNSLRAEDTA VYYCARGGLMVRGLFYYGMDVWGQGTTVTVSSASTKGPSVFPLAPC SRSTSESTAALGCLVKDYFPEPVTVSWNSGALTSGVHTFPAVLQSS GLYSLSSVVTVPSSNFGTQTYTCNVDHKPSNTKVDKTVERKCCVEC PPCPAPELLGGPSVFLFPPKPKDTLMISRTPEVTCVVVDVSHEDPE VKFNWYVDGVEVHNAKTKPREEQYNSTYRVVSVLTVLHQDWLNGKE YKCKVSNKALPAPIEKTISKAKGQPREPQVYTLPPSREEMTKNQVS LTCLVKGFYPSDIAVEWESNGQPENNYKTTPPVLDSDGSFFLYSKL TVDKSRWQQGNVFSCSVMHEALHNHYTQKSLSLSPG |
| 256 | 8A6 (VH + G2.g1.1) or 8A6-IgG2-IgG1.1 | QVQLVESGGGVVQPGRSLRLSCTASGFTFSSYGMQWVRQAPGKGLE WVAVIWYEGSNKYYADSVKGRFTISRENSKNTLYLQMNSLRAEDTA VYYCARGGLMVRGLFYYGMDVWGQGTTVTVSSASTKGPSVFPLAPC SRSTSESTAALGCLVKDYFPEPVTVSWNSGALTSGVHTFPAVLQSS GLYSLSSVVTVPSSNFGTQTYTCNVDHKPSNTKVDKTVERKCCVEC PPCPAPPVAGPSVFLFPPKPKDTLMISRTPEVTCVVVDVSHEDPEV KFNWYVDGVEVHNAKTKPREEQYNSTYRVVSVLTVLHQDWLNGKEY KCKVSNKALPSSIEKTISKAKGQPREPQVYTLPPSREEMTKNQVSL TCLVKGFYPSDIAVEWESNGQPENNYKTTPPVLDSDGSFFLYSKLT VDKSRWQQGNVFSCSVMHEALHNHYTQKSLSLSPG |
| 257 | 8A6 (VH + G2(C219S).g1) or 8A6-IgG2-C219S-IgG1 | QVQLVESGGGVVQPGRSLRLSCTASGFTFSSYGMQWVRQAPGKGLE WVAVIWYEGSNKYYADSVKGRFTISRENSKNTLYLQMNSLRAEDTA VYYCARGGLMVRGLFYYGMDVWGQGTTVTVSSASTKGPSVFPLAPC SRSTSESTAALGCLVKDYFPEPVTVSWNSGALTSGVHTFPAVLQSS GLYSLSSVVTVPSSNFGTQTYTCNVDHKPSNTKVDKTVERKSCVEC PPCPAPELLGGPSVFLFPPKPKDTLMISRTPEVTCVVVDVSHEDPE VKFNWYVDGVEVHNAKTKPREEQYNSTYRVVSVLTVLHQDWLNGKE YKCKVSNKALPAPIEKTISKAKGQPREPQVYTLPPSREEMTKNQVS LTCLVKGFYPSDIAVEWESNGQPENNYKTTPPVLDSDGSFFLYSKL TVDKSRWQQGNVFSCSVMHEALHNHYTQKSLSLSPG |
| 258 | 8A6 (VH + G2(C219S).g1.1) or 8A6-IgG2-C219S-IgG1.1 | QVQLVESGGGVVQPGRSLRLSCTASGFTFSSYGMQWVRQAPGKGLE WVAVIWYEGSNKYYADSVKGRFTISRENSKNTLYLQMNSLRAEDTA VYYCARGGLMVRGLFYYGMDVWGQGTTVTVSSASTKGPSVFPLAPC SRSTSESTAALGCLVKDYFPEPVTVSWNSGALTSGVHTFPAVLQSS GLYSLSSVVTVPSSNFGTQTYTCNVDHKPSNTKVDKTVERKSCVEC PPCPAPPVAGPSVFLFPPKPKDTLMISRTPEVTCVVVDVSHEDPEV KFNWYVDGVEVHNAKTKPREEQYNSTYRVVSVLTVLHQDWLNGKEY KCKVSNKALPSSIEKTISKAKGQPREPQVYTLPPSREEMTKNQVSL TCLVKGFYPSDIAVEWESNGQPENNYKTTPPVLDSDGSFFLYSKLT VDKSRWQQGNVFSCSVMHEALHNHYTQKSLSLSPG |
| 259 | 9G7 (VH + G2) or 9G7-IgG2 | EVQLVESGGGLVKPGGSLRLSCAASGFTFSTVWMSWVRQAPGKGLE WVGRIKSKTDGGTTDYAAPVKGRFTISRDDSKNTLYLQMNSLHTED TAVYYCTTGQLIPYSYYYGMDVWGQGTSVTVSSASTKGPSVFPLAP CSRSTSESTAALGCLVKDYFPEPVTVSWNSGALTSGVHTFPAVLQS SGLYSLSSVVTVPSSNFGTQTYTCNVDHKPSNTKVDKTVERKCCVE CPPCPAPPVAGPSVFLFPPKPKDTLMISRTPEVTCVVVDVSHEDPE VQFNWYVDGVEVHNAKTKPREEQFNSTFRVVSVLTVVHQDWLNGKE YKCKVSNKGLPAPIEKTISKTKGQPREPQVYTLPPSREEMTKNQVS LTCLVKGFYPSDIAVEWESNGQPENNYKTTPPMLDSDGSFFLYSKL TVDKSRWQQGNVFSCSVMHEALHNHYTQKSLSLSPG |
| 260 | 9G7 (VH + G2(C219S)) or 9G7-IgG2-C219S | EVQLVESGGGLVKPGGSLRLSCAASGFTFSTVWMSWVRQAPGKGLE WVGRIKSKTDGGTTDYAAPVKGRFTISRDDSKNTLYLQMNSLHTED TAVYYCTTGQLIPYSYYYGMDVWGQGTSVTVSSASTKGPSVFPLAP CSRSTSESTAALGCLVKDYFPEPVTVSWNSGALTSGVHTFPAVLQS SGLYSLSSVVTVPSSNFGTQTYTCNVDHKPSNTKVDKTVERKSCVE CPPCPAPPVAGPSVFLFPPKPKDTLMISRTPEVTCVVVDVSHEDPE VQFNWYVDGVEVHNAKTKPREEQFNSTFRVVSVLTVVHQDWLNGKE YKCKVSNKGLPAPIEKTISKTKGQPREPQVYTLPPSREEMTKNQVS LTCLVKGFYPSDIAVEWESNGQPENNYKTTPPMLDSDGSFFLYSKL TVDKSRWQQGNVFSCSVMHEALHNHYTQKSLSLSPG |
| 261 | 9G7 (VH + G2.g1) or 9G7-IgG2-IgG1 | EVQLVESGGGLVKPGGSLRLSCAASGFTFSTVWMSWVRQAPGKGLE WVGRIKSKTDGGTTDYAAPVKGRFTISRDDSKNTLYLQMNSLHTED TAVYYCTTGQLIPYSYYYGMDVWGQGTSVTVSSASTKGPSVFPLAP CSRSTSESTAALGCLVKDYFPEPVTVSWNSGALTSGVHTFPAVLQS SGLYSLSSVVTVPSSNFGTQTYTCNVDHKPSNTKVDKTVERKCCVE CPPCPAPELLGGPSVFLFPPKPKDTLMISRTPEVTCVVVDVSHEDP EVKFNWYVDGVEVHNAKTKPREEQYNSTYRVVSVLTVLHQDWLNGK EYKCKVSNKALPAPIEKTISKAKGQPREPQVYTLPPSREEMTKNQV |

US 11,213,586 B2

TABLE 15-continued

SUMMARY OF SEQUENCE LISTING

| SEQ ID | Description | Sequence |
|---|---|---|
| | | SLTCLVKGFYPSDIAVEWESNGQPENNYKTTPPVLDSDGSFFLYSK<br>LTVDKSRWQQGNVFSCSVMHEALHNHYTQKSLSLSPG |
| 262 | 9G7 (VH + G2.g1.1) or<br>9G7-IgG2-IgG1.1 | EVQLVESGGGLVKPGGSLRLSCAASGFTFSTVWMSWVRQAPGKGLE<br>WVGRIKSKTDGGTTDYAAPVKGRFTISRDDSKNTLYLQMNSLHTED<br>TAVYYCTTGQLIPYSYYYGMDVWGQGTSVTVSS<u>ASTKGPSVFPLAP<br>CSRSTSESTAALGCLVKDYFPEPVTVSWNSGALTSGVHTFPAVLQS<br>SGLYSLSSVVTVPSSNFGTQTYTCNVDHKPSNTKVDKTVERKCCVE<br>CPPCPAPPVAGPSVFLFPPKPKDTLMISRTPEVTCVVVDVSHEDPE<br>VKFNWYVDGVEVHNAKTKPREEQYNSTYRVVSVLTVLHQDWLNGKE<br>YKCKVSNKALPSSIEKTISKAKGQPREPQVYTLPPSREEMTKNQVS<br>LTCLVKGFYPSDIAVEWESNGQPENNYKTTPPVLDSDGSFFLYSKL<br>TVDKSRWQQGNVFSCSVMHEALHNHYTQKSLSLSPG</u> |
| 263 | 9G7 (VH + G2(C219S).g1) or<br>9G7-IgG2-C219S-IgG1 | EVQLVESGGGLVKPGGSLRLSCAASGFTFSTVWMSWVRQAPGKGLE<br>WVGRIKSKTDGGTTDYAAPVKGRFTISRDDSKNTLYLQMNSLHTED<br>TAVYYCTTGQLIPYSYYYGMDVWGQGTSVTVSS<u>ASTKGPSVFPLAP<br>CSRSTSESTAALGCLVKDYFPEPVTVSWNSGALTSGVHTFPAVLQS<br>SGLYSLSSVVTVPSSNFGTQTYTCNVDHKPSNTKVDKTVERKSCVE<br>CPPCPAPELLGGPSVFLFPPKPKDTLMISRTPEVTCVVVDVSHEDP<br>EVKFNWYVDGVEVHNAKTKPREEQYNSTYRVVSVLTVLHQDWLNGK<br>EYKCKVSNKALPAPIEKTISKAKGQPREPQVYTLPPSREEMTKNQV<br>SLTCLVKGFYPSDIAVEWESNGQPENNYKTTPPVLDSDGSFFLYSK<br>LTVDKSRWQQGNVFSCSVMHEALHNHYTQKSLSLSPG</u> |
| 264 | 9G7 (VH + G2(C219S).g1.1) or<br>9G7-IgG2-C219S-IgG1.1 | EVQLVESGGGLVKPGGSLRLSCAASGFTFSTVWMSWVRQAPGKGLE<br>WVGRIKSKTDGGTTDYAAPVKGRFTISRDDSKNTLYLQMNSLHTED<br>TAVYYCTTGQLIPYSYYYGMDVWGQGTSVTVSS<u>ASTKGPSVFPLAP<br>CSRSTSESTAALGCLVKDYFPEPVTVSWNSGALTSGVHTFPAVLQS<br>SGLYSLSSVVTVPSSNFGTQTYTCNVDHKPSNTKVDKTVERKSCVE<br>CPPCPAPPVAGPSVFLFPPKPKDTLMISRTPEVTCVVVDVSHEDPE<br>VKFNWYVDGVEVHNAKTKPREEQYNSTYRVVSVLTVLHQDWLNGKE<br>YKCKVSNKALPSSIEKTISKAKGQPREPQVYTLPPSREEMTKNQVS<br>LTCLVKGFYPSDIAVEWESNGQPENNYKTTPPVLDSDGSFFLYSKL<br>TVDKSRWQQGNVFSCSVMHEALHNHYTQKSLSLSPG</u> |
| 265 | 14E3 (VH + G2) or<br>14E3-IgG2 | QVQLQQWGAGLLKPSETLSLTCAVYGGSFSGYYWSWIRQPPGKGLE<br>WIGEINHSGNTYYNPSLKSRVTISVDTSKNQLSLKLSSVTAADTAV<br>YYCARFGSNDAFDIWGQGTMVTVSS<u>ASTKGPSVFPLAPCSRSTSES<br>TAALGCLVKDYFPEPVTVSWNSGALTSGVHTFPAVLQSSGLYSLSS<br>VVTVPSSNFGTQTYTCNVDHKPSNTKVDKTVERKCCVECPPCPAPP<br>VAGPSVFLFPPKPKDTLMISRTPEVTCVVVDVSHEDPEVQFNWYVD<br>GVEVHNAKTKPREEQFNSTFRVVSVLTVVHQDWLNGKEYKCKVSNK<br>GLPAPIEKTISKTKGQPREPQVYTLPPSREEMTKNQVSLTCLVKGF<br>YPSDIAVEWESNGQPENNYKTTPPMLDSDGSFFLYSKLTVDKSRWQ<br>QGNVFSCSVMHEALHNHYTQKSLSLSPG</u> |
| 266 | 14E3 (VH + G2(C219S)) or<br>14E3-IgG2-C219S | QVQLQQWGAGLLKPSETLSLTCAVYGGSFSGYYWSWIRQPPGKGLE<br>WIGEINHSGNTYYNPSLKSRVTISVDTSKNQLSLKLSSVTAADTAV<br>YYCARFGSNDAFDIWGQGTMVTVSS<u>ASTKGPSVFPLAPCSRSTSES<br>TAALGCLVKDYFPEPVTVSWNSGALTSGVHTFPAVLQSSGLYSLSS<br>VVTVPSSNFGTQTYTCNVDHKPSNTKVDKTVERKSCVECPPCPAPP<br>VAGPSVFLFPPKPKDTLMISRTPEVTCVVVDVSHEDPEVQFNWYVD<br>GVEVHNAKTKPREEQFNSTFRVVSVLTVVHQDWLNGKEYKCKVSNK<br>GLPAPIEKTISKTKGQPREPQVYTLPPSREEMTKNQVSLTCLVKGF<br>YPSDIAVEWESNGQPENNYKTTPPMLDSDGSFFLYSKLTVDKSRWQ<br>QGNVFSCSVMHEALHNHYTQKSLSLSPG</u> |
| 267 | 14E3 (VH + G2.g1) or<br>14E3-IgG2-IgG1 | QVQLQQWGAGLLKPSETLSLTCAVYGGSFSGYYWSWIRQPPGKGLE<br>WIGEINHSGNTYYNPSLKSRVTISVDTSKNQLSLKLSSVTAADTAV<br>YYCARFGSNDAFDIWGQGTMVTVSS<u>ASTKGPSVFPLAPCSRSTSES<br>TAALGCLVKDYFPEPVTVSWNSGALTSGVHTFPAVLQSSGLYSLSS<br>VVTVPSSNFGTQTYTCNVDHKPSNTKVDKTVERKCCVECPPCPAPE<br>LLGGPSVFLFPPKPKDTLMISRTPEVTCVVVDVSHEDPEVKFNWYV<br>DGVEVHNAKTKPREEQYNSTYRVVSVLTVLHQDWLNGKEYKCKVSN<br>KALPAPIEKTISKAKGQPREPQVYTLPPSREEMTKNQVSLTCLVKG<br>FYPSDIAVEWESNGQPENNYKTTPPVLDSDGSFFLYSKLTVDKSRW<br>QQGNVFSCSVMHEALHNHYTQKSLSLSPG</u> |
| 268 | 14E3 (VH + G2.g1.1) or<br>14E3-IgG2-IgG1.1 | QVQLQQWGAGLLKPSETLSLTCAVYGGSFSGYYWSWIRQPPGKGLE<br>WIGEINHSGNTYYNPSLKSRVTISVDTSKNQLSLKLSSVTAADTAV<br>YYCARFGSNDAFDIWGQGTMVTVSS<u>ASTKGPSVFPLAPCSRSTSES<br>TAALGCLVKDYFPEPVTVSWNSGALTSGVHTFPAVLQSSGLYSLSS<br>VVTVPSSNFGTQTYTCNVDHKPSNTKVDKTVERKCCVECPPCPAPP<br>VAGPSVFLFPPKPKDTLMISRTPEVTCVVVDVSHEDPEVKFNWYVD</u> |

TABLE 15-continued

SUMMARY OF SEQUENCE LISTING

| SEQ ID | Description | Sequence |
|---|---|---|
| | | GVEVHNAKTKPREEQYNSTYRVVSVLTVLHQDWLNGKEYKCKVSNK<br>ALPSSIEKTISKAKGQPREPQVYTLPPSREEMTKNQVSLTCLVKGF<br>YPSDIAVEWESNGQPENNYKTTPPVLDSDGSFFLYSKLTVDKSRWQ<br>QGNVFSCSVMHEALHNHYTQKSLSLSPG |
| 269 | 14E3 (VH + G2(C219S).g1) or<br>14E3-IgG2-C219S-IgG1 | QVQLQQWGAGLLKPSETLSLTCAVYGGSFSGYYWSWIRQPPGKGLE<br>WIGEINHSGNTYYNPSLKSRVTISVDTSKNQLSLKLSSVTAADTAV<br>YYCARFGSNDAFDIWGQGTMVTVSSASTKGPSVFPLAPCSRSTSES<br>TAALGCLVKDYFPEPVTVSWNSGALTSGVHTFPAVLQSSGLYSLSS<br>VVTVPSSNFGTQTYTCNVDHKPSNTKVDKTVERKSCVECPPCPAPE<br>LLGGPSVFLFPPKPKDTLMISRTPEVTCVVVDVSHEDPEVKFNWYV<br>DGVEVHNAKTKPREEQYNSTYRVVSVLTVLHQDWLNGKEYKCKVSN<br>KALPAPIEKTISKAKGQPREPQVYTLPPSREEMTKNQVSLTCLVKG<br>FYPSDIAVEWESNGQPENNYKTTPPVLDSDGSFFLYSKLTVDKSRW<br>QQGNVFSCSVMHEALHNHYTQKSLSLSPG |
| 270 | 14E3 (VH + G2(C219S).g1.1) or<br>14E3-IgG2-C219S-IgG1.1 | QVQLQQWGAGLLKPSETLSLTCAVYGGSFSGYYWSWIRQPPGKGLE<br>WIGEINHSGNTYYNPSLKSRVTISVDTSKNQLSLKLSSVTAADTAV<br>YYCARFGSNDAFDIWGQGTMVTVSSASTKGPSVFPLAPCSRSTSES<br>TAALGCLVKDYFPEPVTVSWNSGALTSGVHTFPAVLQSSGLYSLSS<br>VVTVPSSNFGTQTYTCNVDHKPSNTKVDKTVERKCCVECPPCPAPP<br>VAGPSVFLFPPKPKDTLMISRTPEVTCVVVDVSHEDPEVKFNWYVD<br>GVEVHNAKTKPREEQYNSTYRVVSVLTVLHQDWLNGKEYKCKVSNK<br>ALPSSIEKTISKAKGQPREPQVYTLPPSREEMTKNQVSLTCLVKGF<br>YPSDIAVEWESNGQPENNYKTTPPVLDSDGSFFLYSKLTVDKSRWQ<br>QGNVFSCSVMHEALHNHYTQKSLSLSPG |
| 131 | 19H8 (VH + G2) or<br>19H8-IgG2 | SEQ ID NO: 131 |
| 271 | 19H8 (VH + G2(C219S)) or<br>19H8-IgG2-C219S | QVQLVESGGGVVQPGRSLRLSCAASGFTFSNYGMHWVRQAPGKGLE<br>WMAVIWYGGSNKFYADSVKGRFTISRDNSKNSLSLQMNSLRAEDTA<br>VYYCARGGAMVRGVYYYGMDVWGQGTTVTVSSASTKGPSVFPLAPC<br>SRSTSESTAALGCLVKDYFPEPVTVSWNSGALTSGVHTFPAVLQSS<br>GLYSLSSVVTVPSSNFGTQTYTCNVDHKPSNTKVDKTVERKSCVEC<br>PPCPAPPVAGPSVFLFPPKPKDTLMISRTPEVTCVVVDVSHEDPEV<br>QFNWYVDGVEVHNAKTKPREEQFNSTFRVVSVLTVLHQDWLNGKEY<br>KCKVSNKGLPAPIEKTISKTKGQPREPQVYTLPPSREEMTKNQVSL<br>TCLVKGFYPSDIAVEWESNGQPENNYKTTPPMLDSDGSFFLYSKLT<br>VDKSRWQQGNVFSCSVMHEALHNHYTQKSLSLSPG |
| 272 | 19H8 (VH + G2.g1) or<br>19H8-IgG2-IgG1 | QVQLVESGGGVVQPGRSLRLSCAASGFTFSNYGMHWVRQAPGKGLE<br>WMAVIWYGGSNKFYADSVKGRFTISRDNSKNSLSLQMNSLRAEDTA<br>VYYCARGGAMVRGVYYYGMDVWGQGTTVTVSSASTKGPSVFPLAPC<br>SRSTSESTAALGCLVKDYFPEPVTVSWNSGALTSGVHTFPAVLQSS<br>GLYSLSSVVTVPSSNFGTQTYTCNVDHKPSNTKVDKTVERKCCVEC<br>PPCPAPELLGGPSVFLFPPKPKDTLMISRTPEVTCVVVDVSHEDPE<br>VKFNWYVDGVEVHNAKTKPREEQYNSTYRVVSVLTVLHQDWLNGKE<br>YKCKVSNKALPAPIEKTISKAKGQPREPQVYTLPPSREEMTKNQVS<br>LTCLVKGFYPSDIAVEWESNGQPENNYKTTPPVLDSDGSFFLYSKL<br>TVDKSRWQQGNVFSCSVMHEALHNHYTQKSLSLSPG |
| 273 | 19H8 (VH + G2.g1.1) or<br>19H8-IgG2-IgG1.1 | QVQLVESGGGVVQPGRSLRLSCAASGFTFSNYGMHWVRQAPGKGLE<br>WMAVIWYGGSNKFYADSVKGRFTISRDNSKNSLSLQMNSLRAEDTA<br>VYYCARGGAMVRGVYYYGMDVWGQGTTVTVSSASTKGPSVFPLAPC<br>SRSTSESTAALGCLVKDYFPEPVTVSWNSGALTSGVHTFPAVLQSS<br>GLYSLSSVVTVPSSNFGTQTYTCNVDHKPSNTKVDKTVERKCCVEC<br>PPCPAPPVAGPSVFLFPPKPKDTLMISRTPEVTCVVVDVSHEDPEV<br>KFNWYVDGVEVHNAKTKPREEQYNSTYRVVSVLTVLHQDWLNGKEY<br>KCKVSNKALPSSIEKTISKAKGQPREPQVYTLPPSREEMTKNQVSL<br>TCLVKGFYPSDIAVEWESNGQPENNYKTTPPVLDSDGSFFLYSKLT<br>VDKSRWQQGNVFSCSVMHEALHNHYTQKSLSLSPG |
| 274 | 19H8 (VH + G2(C219S).g1) or<br>19H8-IgG2-C219S-IgG1 | QVQLVESGGGVVQPGRSLRLSCAASGFTFSNYGMHWVRQAPGKGLE<br>WMAVIWYGGSNKFYADSVKGRFTISRDNSKNSLSLQMNSLRAEDTA<br>VYYCARGGAMVRGVYYYGMDVWGQGTTVTVSSASTKGPSVFPLAPC<br>SRSTSESTAALGCLVKDYFPEPVTVSWNSGALTSGVHTFPAVLQSS<br>GLYSLSSVVTVPSSNFGTQTYTCNVDHKPSNTKVDKTVERKSCVEC<br>PPCPAPELLGGPSVFLFPPKPKDTLMISRTPEVTCVVVDVSHEDPE<br>VKFNWYVDGVEVHNAKTKPREEQYNSTYRVVSVLTVLHQDWLNGKE<br>YKCKVSNKALPAPIEKTISKAKGQPREPQVYTLPPSREEMTKNQVS<br>LTCLVKGFYPSDIAVEWESNGQPENNYKTTPPVLDSDGSFFLYSKL<br>TVDKSRWQQGNVFSCSVMHEALHNHYTQKSLSLSPG |

TABLE 15-continued

SUMMARY OF SEQUENCE LISTING

| SEQ ID | Description | Sequence |
|---|---|---|
| 275 | 19H8 (VH + G2(C219S).g1.1) or 19H8-IgG2-C219S-IgG1.1 | QVQLVESGGGVVQPGRSLRLSCAASGFTFSNYGMHWVRQAPGKGLE WMAVIWYGGSNKFYADSVKGRFTISRDNSKNSLSLQMNSLRAEDTA VYYCARGGAMVRGVYYYGMDVWGQGTTVTVSSASTKGPSVFPLAPC SRSTSESTAALGCLVKDYFPEPVTVSWNSGALTSGVHTFPAVLQSS GLYSLSSVVTVPSSNFGTQTYTCNVDHKPSNTKVDKTVERKSCVEC PPCPAPPVAGPSVFLFPPKPKDTLMISRTPEVTCVVVDVSHEDPEV KFNWYVDGVEVHNAKTKPREEQYNSTYRVVSVLTVLHQDWLNGKEY KCKVSNKALPSSIEKTISKAKGQPREPQVYTLPPSREEMTKNQVSL TCLVKGFYPSDIAVEWESNGQPENNYKTTPPVLDSDGSFFLYSKLT VDKSRWQQGNVFSCSVMHEALHNHYTQKSLSLSPG |
| 276 | Heavy chain C-terminus | LSPG |
| 277 | — | |
| 278 | Wildtype human IgG1 CH1 | ASTKGPSVFPLAPSSKSTSGGTAALGCLVKDYFPEPVTVSWNSGAL TSGVHTFPAVLQSSGLYSLSSVVTVPSSSLGTQTYICNVNHKPSNT KVDKKV |
| 279 | Wildtype human IgG2 CH1 | ASTKGPSVFPLAPCSRSTSESTAALGCLVKDYFPEPVTVSWNSGAL TSGVHTFPAVLQSSGLYSLSSVVTVPSSNFGTQTYTCNVDHKPSNT KVDKTV |
| 280 | Wildtype human IgG1 CH2 | PSVFLFPPKPKDTLMISRTPEVTCVVVDVSHEDPEVKFNWYVDGVE VHNAKTKPREEQYNSTYRVVSVLTVLHQDWLNGKEYKCKVSNKALP APIEKTISKAK |
| 281 | Human IgG1 CH2 with A330S/P331S | PSVFLFPPKPKDTLMISRTPEVTCVVVDVSHEDPEVKFNWYVDGVE VHNAKTKPREEQYNSTYRVVSVLTVLHQDWLNGKEYKCKVSNKALP SSIEKTISKAK |
| 282 | Wildtype human IgG1 CH3 | GQPREPQVYTLPPSREEMTKNQVSLTCLVKGFYPSDIAVEWESNGQ PENNYKTTPPVLDSDGSFFLYSKLTVDKSRWQQGNVFSCSVMHEAL HNHYTQKSLSLSPG |
| 283 | IgG1-IgG2-IgG1f | ASTKGPSVFPLAPSSKSTSGGTAALGCLVKDYFPEPVTVSWNSGAL TSGVHTFPAVLQSSGLYSLSSVVTVPSSSLGTQTYICNVNHKPSNT KVDKKVERKCCVECPPCPAPELLGGPSVFLFPPKPKDTLMISRTPE VTCVVVDVSHEDPEVKFNWYVDGVEVHNAKTKPREEQYNSTYRVVS VLTVLHQDWLNGKEYKCKVSNKALPAPIEKTISKAKGQPREPQVYT LPPSREEMTKNQVSLTCLVKGFYPSDIAVEWESNGQPENNYKTTPP VLDSDGSFFLYSKLTVDKSRWQQGNVFSCSVMHEALHNHYTQKSLS LSPG |
| 284 | IgG1-IgG2CS-IgG1f | ASTKGPSVFPLAPSSKSTSGGTAALGCLVKDYFPEPVTVSWNSGAL TSGVHTFPAVLQSSGLYSLSSVVTVPSSSLGTQTYICNVNHKPSNT KVDKKVERKSCVECPPCPAPPVAGPSVFLFPPKPKDTLMISRTPEV TCVVVDVSHEDPEVKFNWYVDGVEVHNAKTKPREEQYNSTYRVVSV LTVLHQDWLNGKEYKCKVSNKALPAPIEKTISKAKGQPREPQVYTL PPSREEMTKNQVSLTCLVKGFYPSDIAVEWESNGQPENNYKTTPPV LDSDGSFFLYSKLTVDKSRWQQGNVFSCSVMHEALHNHYTQKSLSL SPG |
| 285 | IgG1-IgG2-IgG1.1f | ASTKGPSVFPLAPSSKSTSGGTAALGCLVKDYFPEPVTVSWNSGAL TSGVHTFPAVLQSSGLYSLSSVVTVPSSSLGTQTYICNVNHKPSNT KVDKKVERKCCVECPPCPAPPVAGPSVFLFPPKPKDTLMISRTPEV TCVVVDVSHEDPEVKFNWYVDGVEVHNAKTKPREEQYNSTYRVVSV LTVLHQDWLNGKEYKCKVSNKALPSSIEKTISKAKGQPREPQVYTL PPSRREMTKNQVSLTCLVKGFYPSDIAVEWESNGQPENNYKTTPPV LDSDGSFFLYSKLTVDKSRWQQGNVFSCSVMHEALHNHYTQKSLSL SPG |
| 286 | IgG1-IgG2CS-IgG1.1f | ASTKGPSVFPLAPSSKSTSGGTAALGCLVKDYFPEPVTVSWNSGAL TSGVHTFPAVLQSSGLYSLSSVVTVPSSSLGTQTYICNVNHKPSNT KVDKKVERKSCVECPPCPAPPVAGPSVFLFPPKPKDTLMISRTPEV TCVVVDVSHEDPEVKFNWYVDGVEVHNAKTKPREEQYNSTYRVVSV LTVLHQDWLNGKEYKCKVSNKALPSSIEKTISKAKGQPREPQVYTL PPSREEMTKNQVSLTCLVKGFYPSDIAVEWESNGQPENNYKTTPPV LDSDGSFFLYSKLTVDKSRWQQGNVFSCSVMHEALHNHYTQKSLSL SPG |
| 287 | IgG1-IgG2-IgG1f2 | ASTKGPSVFPLAPSSKSTSGGTAALGCLVKDYFPEPVTVSWNSGAL TSGVHTFPAVLQSSGLYSLSSVVTVPSSSLGTQTYICNVNHKPSNT KVDKKVERKCCVECPPCPAPPVAGPSVFLFPPKPKDTLMISRTPEV TCVVVDVSHEDPEVKFNWYVDGVEVHNAKTKPREEQYNSTYRVVSV |

TABLE 15-continued

SUMMARY OF SEQUENCE LISTING

| SEQ ID | Description | Sequence |
|---|---|---|
| | | LTVLHQDWLNGKEYKCKVSNKALPAPIEKTISKAKGQPREPQVYTL<br>PPSREEMTKNQVSLTCLVKGFYPSDIAVEWESNGQPENNYKTTPPV<br>LDSDGSFFLYSKLTVDKSRWQQGNVFSCSVMHEALHNHYTQKSLSL<br>SPG |
| 288 | IgG1-IgG2(C219S)-IgG1f2 | ASTKGPSVFPLAPSSKSTSGGTAALGCLVKDYFPEPVTVSWNSGAL<br>TSGVHTFPAVLQSSGLYSLSSVVTVPSSSLGTQTYICNVNHKPSNT<br>KVDKKVERKSCVECPPCPAPPVAGPSVFLFPPKPKDTLMISRTPEV<br>TCVVVDVSHEDPEVKFNWYVDGVEVHNAKTKPREEQYNSTYRVVSV<br>LTVLHQDWLNGKEYKCKVSNKALPAPIEKTISKAKGQPREPQVYTL<br>PPSREEMTKNQVSLTCLVKGFYPSDIAVEWESNGQPENNYKTTPPV<br>LDSDGSFFLYSKLTVDKSRWQQGNVFSCSVMHEALHNHYTQKSLSL<br>SPG |
| 289 | IgG2-IgG1f2 | ASTKGPSVFPLAPCSRSTSESTAALGCLVKDYFPEPVTVSWNSGAL<br>TSGVHTFPAVLQSSGLYSLSSVVTVPSSNFGTQTYTCNVDHKPSNT<br>KVDKTVERKCCVECPPCPAPPVAGPSVFLFPPKPKDTLMISRTPEV<br>TCVVVDVSHEDPEVKFNWYVDGVEVHNAKTKPREEQYNSTYRVVSV<br>LTVLHQDWLNGKEYKCKVSNKALPAPIEKTISKAKGQPREPQVYTL<br>PPSREEMTKNQVSLTCLVKGFYPSDIAVEWESNGQPENNYKTTPPV<br>LDSDGSFFLYSKLTVDKSRWQQGNVFSCSVMHEALHNHYTQKSLSL<br>SPG |
| 290 | IgG2(C219S)-IgG1f2 | ASTKGPSVFPLAPCSRSTSESTAALGCLVKDYFPEPVTVSWNSGAL<br>TSGVHTFPAVLQSSGLYSLSSVVTVPSSNFGTQTYTCNVDHKPSNT<br>KVDKTVERKSCVECPPCPAPPVAGPSVFLFPPKPKDTLMISRTPEV<br>TCVVVDVSHEDPEVKFNWYVDGVEVHNAKTKPREEQYNSTYRVVSV<br>LTVLHQDWLNGKEYKCKVSNKALPAPIEKTISKAKGQPREPQVYTL<br>PPSREEMTKNQVSLTCLVKGFYPSDIAVEWESNGQPENNYKTTPPV<br>LDSDGSFFLYSKLTVDKSRWQQGNVFSCSVMHEALHNHYTQKSLSL<br>SPG |
| 291 | WT human IgG2 hinge | ERKCCVECPPCPAPPVAG |
| 292 | Human IgG2 hinge with C219S | ERKSCVECPPCPAPPVAG |
| 293 | IgG2/IgG1 hinge | ERKCCVECPPCPAPELLGG |
| 294 | IgG2 (C219S)/IgG1 hinge | ERKSCVECPPCPAPELLGG |
| 295 | Wild type human IgG1 hinge | EPKSCDKTHTCPPCPAPELLGG |
| 296 | IgG1.1 Hinge (L234A/L235E/G237A) | EPKSCDKTHTCPPCPAPEAEGA |
| 297 | Wildtype human IgG2 CH2 | PSVFLFPPKPKDTLMISRTPEVTCVVVDVSHEDPEVQFNWYVDGVE<br>VHNAKTKPREEQFNSTFRVVSVLTVVHQDWLNGKEYKCKVSNKGLP<br>APIEKTISKTK |
| 298 | Wildtype human IgG2 CH3 | GQPREPQVYTLPPSREEMTKNQVSLTCLVKGFYPSDIAVEWESNGQ<br>PENNYKTTPPMLDSDGSFFLYSKLTVDKSRWQQGNVFSCSVMHEAL<br>HNHYTQKSLSLSPGK |
| 299 | IgG1 C-termianl $C_H1$ (same for IgG3 (17-15-15-15), igG3 (17-15-15), IgG3 (17-15), IgG3 (15-15-15), IgG3 (15), and IgG4 | VDKRV |
| 300 | IgG2 C-termianl $C_H1$ | VDKTV |
| 301 | IgG1 upper hinge | EPKSCDKTHT |
| 302 | IgG3 (17-15-15-15) upper hinge (same for IgG3 (17-15-15) and IgG3 (17-15)) | ELKTPLGDTTHT |
| 303 | IgG3 (15-15-15) upper hinge (same for IgG3(15)) | EPKS |
| 304 | IgG4 upper hinge | ESKYGPP |
| 305 | IgG1 middle hinge | CPPCP |
| 306 | IgG2 middle hinge | CCVECPPCP |

TABLE 15-continued

SUMMARY OF SEQUENCE LISTING

| SEQ ID | Description | Sequence |
|---|---|---|
| 307 | IgG3 (17-15-15-15) middle hinge | CPRCP(EPKSCDTPPPCPRCP)$_3$ |
| 308 | IgG3 (17-15-15) middle hinge | CPRCP(EPKSCDTPPPCPRCP)$_2$ |
| 309 | IgG3 (17-15) middle hinge | CPRCPEPKSCDTPPPCPRCP |
| 310 | IgG3 (15-15-15) middle hinge | CDTPPPCPRCP(EPKSCDTPPPCPRCP)$_2$ |
| 311 | IgG3 (15) middle hinge | CDTPPPCPRCP |
| 312 | IgG4 middle hinge | CPSCP |
| 313 | IgG1 lower hinge (same for IgG3 (17-15-15-15), IgG3 (17-15-15), IgG3 (17-15), IgG3 (15-15-15), IgG3 (15), and IgG4) | APELLGG |
| 314 | IgG2 lower hinge | APPVAG |
| 315 | 28F3 VH signal sequence (same for 18E10, 19D3, 19H8, 6G10) | MEFGLSWVFLVALLRGVQC |
| 316 | 28F3 VH signal sequence (nucleotide sequence) | ATGGAGTTTGGGCTGAGCTGGGTTTTCCTCGTTGCTCTTTTAAGAG GTGTCCAGTGT |
| 317 | 28F3 VL signal sequence (same for 18E10, 8A6, 19H8VL1, 6G10) | MDMRVPAQLLGLLLLWLPGARC |
| 318 | 28F3 VL signal sequence (nucleotide sequence) | ATGGACATGAGGGTCCCCGCTCAGCTCCTGGGGCTTCTGCTGCTCT GGCTCCCAGGTGCCAGAT |
| 319 | 19D3 VL signal sequence | MRVLAQLLGLLLLCFPGARC |
| 320 | 19D3 VL signal sequence (nucleotide sequence) | ATGAGGGTCCTCGCTCAGCTCCTGGGGCTCCTGCTGCTCTGTTTCC CAGGTGCCAGATGT |
| 321 | 3C3 VH signal sequence (same for 14E3) | MKHLWFFLLLVAAPRWVLS |
| 322 | 3C3 VH signal sequence (nucleotide sequence) | ATGAAACACCTGTGGTTCTTCCTCCTCCTGGTGGCAGCTCCCAGAT GGGTCCTGTCC |
| 323 | 3C3 VL signal sequence (same for 14E3) | MDMRVLAQLLGLLLLCFPGARC |
| 324 | 3C3 VL signal sequence (nucleotide sequence) | ATGGACATGAGGGTCCTCGCTCAGCTCCTGGGGCTCCTGCTGCTCT GTTTCCCAGGTGCCAGATGT |
| 325 | 3C3 VL2 signal sequence (same for 19H8 VL2) | MEAPAQLLFLLLLWLPDTTG |
| 326 | 3C3 VL2 signal sequence (nucleotide sequence) | ATGGAAGCCCCAGCGCAGCTTCTCTTCCTCCTGCTACTCTGGCTCC CAGATACCACCGGA |
| 327 | 8A6 VH signal sequence | MEFGLNWVFLVALLRGVQC |
| 328 | 8A6 VH signal sequence (nucleotide sequence) | ATGGAGTTTGGGCTGAACTGGGTTTTCCTCGTTGCTCTTTTAAGAG GTGTCCAGTGT |
| 329 | 9G7 VH signal sequence | MEFGLSWIFLAAILKGVQC |
| 330 | 9G7 VH signal sequence (nucleotide sequence) | ATGGAGTTTGGGCTGAGCTGGATTTTCCTTGCTGCTATTTTAAAAG GTGTCCAGTGT |
| 331 | 9G7 VL1 and VL2 signal sequence | METPAQLLFLLLLWLPDTTG |
| 332 | 9G7 VL1 and VL2 signal sequence (nucleotide sequence) | ATGGAAACCCCAGCGCAGCTTCTCTTCCTCCTGCTACTCTGGCTCC CAGATACCACCGGA |
| 333 | 14E3 VH signal sequence | MKHLWFFLLLVAAPRWVLS |
| 334 | 14E3 VH signal sequence (nucleotide sequence) | ATGAAACACCTGTGGTTCTTCCTCCTCCTGGTGGCAGCTCCCAGAT GGGTCCTGTCC |

TABLE 15-continued

SUMMARY OF SEQUENCE LISTING

| SEQ ID | Description | Sequence |
|---|---|---|
| 335 | 6G10 (VH) | QVQLVESGGDVVQPGRSLRLSCAASGFTFSTYGMHWVRQAPGKGLE WVAVTWYAGSNKFYADSVKGRFTISRDNSKNTLYLQMNSLRAEDTA VYYCARGGSMVRGLYYYGMDVWGQGTTVTSS |
| 336 | 6G10 (VL) | AIQLTQSPSSLSASVGDRVTITCRASQGISSALAWYQQKPGKAPKL LIYDASSLESGVPSRFSGSGSGTDFTLTISSLQPEDFATYYCQQFN SYPYTFGQGTKLEIK |
| 337 | 6G10 (full length wild-type heavy chain) The constant region is underlined | QVQLVESGGDVVQPGRSLRLSCAASGFTFSTYGMHWVRQAPGKGLE WVAVTWYAGSNKFYADSVKGRFTISRDNSKNTLYLQMNSLRAEDTA VYYCARGGSMVRGLYYYGMDVWGQGTTVTSS<u>ASTKGPSVFPLAPC SRSTSESTAALGCLVKDYFPEPVTVSWNSGALTSGVHTFPAVLQSS GLYSLSSVVTVPSSNFGTQTYTCNVDHKPSNTKVDKTVERKCCVEC PPCPAPPVAGPSVFLFPPKPKDTLMISRTPEVTCVVVDVSHEDPEV QFNWYVDGVEVHNAKTKPREEQFNSTFRVVSVLTVVHQDWLNGKEY KCKVSNKGLPAPIEKTISKTKGQPREPQVYTLPPSREEMTKNQVSL TCLVKGFYPSDIAVEWESNGQPENNYKTTPPMLDSDGSFFLYSKLT VDKSRWQQGNVFSCSVMHEALHNHYTQKSLSLSPGK</u> |
| 338 | 6G10 (full length wild-type light chain) The constant region is underlined | AIQLTQSPSSLSASVGDRVTITCRASQGISSALAWYQQKPGKAPKL LIYDASSLESGVPSRFSGSGSGTDFTLTISSLQPEDFATYYCQQFN SYPYTFGQGTKLEIK<u>RTVAAPSVFIFPPSDEQLKSGTASVVCLLNN FYPREAKVQWKVDNALQSGNSQESVTEQDSKDSTYSLSSTLTLSKA DYEKHKVYACEVTHQGLSSPVTKSFNRGEC</u> |
| 339 | 6G10.IgG1 (VH + IgG1) | QVQLVESGGDVVQPGRSLRLSCAASGFTFSTYGMHWVRQAPGKGLE WVAVTWYAGSNKFYADSVKGRFTISRDNSKNTLYLQMNSLRAEDTA VYYCARGGSMVRGLYYYGMDVWGQGTTVTSSASTKGPSVFPLAPS SKSTSGGTAALGCLVKDYFPEPVTVSWNSGALTSGVHTFPAVLQSS GLYSLSSVVTVPSSSLGTQTYICNVNHKPSNTKVDKRVEPKSCDKT HTCPPCPAPELLGGPSVFLFPPKPKDTLMISRTPEVTCVVVDVSHE DPEVKFNWYVDGVEVHNAKTKPREEQYNSTYRVVSVLTVLHQDWLN GKEYKCKVSNKALPAPIEKTISKAKGQPREPQVYTLPPSREEMTKN QVSLTCLVKGFYPSDIAVEWESNGQPENNYKTTPPVLDSDGSFFLY SKLTVDKSRWQQGNVFSCSVMHEALHNHYTQKSLSLSPG |
| 340 | 6G10.IgG1.1 (VH + IgG1.1) | QVQLVESGGDVVQPGRSLRLSCAASGFTFSTYGMHWVRQAPGKGLE WVAVTWYAGSNKFYADSVKGRFTISRDNSKNTLYLQMNSLRAEDTA VYYCARGGSMVRGLYYYGMDVWGQGTTVTSSASTKGPSVFPLAPS SKSTSGGTAALGCLVKDYFPEPVTVSWNSGALTSGVHTFPAVLQSS GLYSLSSVVTVPSSSLGTQTYICNVNHKPSNTKVDKRVEPKSCDKT HTCPPCPAPE<u>AEGA</u>PSVFLFPPKPKDTLMISRTPEVTCVVVDVSHE DPEVKFNWYVDGVEVHNAKTKPREEQYNSTYRVVSVLTVLHQDWLN GKEYKCKVSNKALP<u>SS</u>IEKTISKAKGQPREPQVYTLPPSREEMTKN QVSLTCLVKGFYPSDIAVEWESNGQPENNYKTTPPVLDSDGSFFLY SKLTVDKSRWQQGNVFSCSVMHEALHNHYTQKSLSLSPG |
| 341 | 6G10.IgG1 (VL + CL) | AIQLTQSPSSLSASVGDRVTITCRASQGISSALAWYQQKPGKAPKL LIYDASSLESGVPSRFSGSGSGTDFTLTISSLQPEDFATYYCQQFN SYPYTFGQGTKLEIKRTVAAPSVFIFPPSDEQLKSGTASVVCLLNN FYPREAKVQWKVDNALQSGNSQESVTEQDSKDSTYSLSSTLTLSKA DYEKHKVYACEVTHQGLSSPVTKSFNRGEC |
| 342 | 6G10 VH CDR1 | TYGMH |
| 343 | 6G10 VH CDR2 | VTWYAGSNKFYADSVKG |
| 344 | 6G10 VH CDR3 | GGSMVRGLYYYGMDV |
| 345 | 6G10 VL CDR1 | RASQGISSALA |
| 346 | 6G10 VL CDR2 | DASSLES |
| 347 | 6G10 VL CDR3 | QQFNSYPYT |
| 337 | 6G10 (VH + G2) or 6G10-IgG2 | SEQ ID NO: 337 |
| 348 | 6G10 (VH + G2(C219S)) or 6G10-IgG2-C219S | QVQLVESGGDVVQPGRSLRLSCAASGFTFSTYGMHWVRQAPGKGLE WVAVTWYAGSNKFYADSVKGRFTISRDNSKNTLYLQMNSLRAEDTA VYYCARGGSMVRGLYYYGMDVWGQGTTVTSSASTKGPSVFPLAPC SRSTSESTAALGCLVKDYFPEPVTVSWNSGALTSGVHTFPAVLQSS GLYSLSSVVTVPSSNFGTQTYTCNVDHKPSNTKVDKTV<u>ERKSCVEC PPCPAPPVAG</u>PSVFLFPPKPKDTLMISRTPEVTCVVVDVSHEDPEV QFNWYVDGVEVHNAKTKPREEQFNSTFRVVSVLTVVHQDWLNGKEY KCKVSNKGLPAPIEKTISKTKGQPREPQVYTLPPSREEMTKNQVSL |

TABLE 15-continued

SUMMARY OF SEQUENCE LISTING

| SEQ ID | Description | Sequence |
|---|---|---|
| | | TCLVKGFYPSDIAVEWESNGQPENNYKTTPPMLDSDGSFFLYSKLT VDKSRWQQGNVFSCSVMHEALHNHYTQKSLSLSPG |
| 349 | 6G10 (VH + G2.g1) or 6G10-IgG2-IgG1 | QVQLVESGGDVVQPGRSLRLSCAASGFTFSTYGMHWVRQAPGKGLE WVAVTWYAGSNKFYADSVKGRFTISRDNSKNTLYLQMNSLRAEDTA VYYCARGGSMVRGLYYYGMDVWGQGTTVTVSSASTKGPSVFPLAPC SRSTSESTAALGCLVKDYFPEPVTVSWNSGALTSGVHTFPAVLQSS GLYSLSSVVTVPSSNFGTQTYTCNVDHKPSNTKVDKTV<u>ERKCCVEC PPCPAPELLGG</u>PSVFLFPPKPKDTLMISRTPEVTCVVVDVSHEDPE VKFNWYVDGVEVHNAKTKPREEQYNSTYRVVSVLTVLHQDWLNGKE YKCKVSNKALPAPIEKTISKAKGQPREPQVYTLPPSREEMTKNQVS LTCLVKGFYPSDIAVEWESNGQPENNYKTTPPVLDSDGSFFLYSKL TVDKSRWQQGNVFSCSVMHEALHNHYTQKSLSLSPG |
| 350 | 6G10 (VH + G2.g1.1) or 6G10-IgG2-IgG1.1 | QVQLVESGGDVVQPGRSLRLSCAASGFTFSTYGMHWVRQAPGKGLE WVAVTWYAGSNKFYADSVKGRFTISRDNSKNTLYLQMNSLRAEDTA VYYCARGGSMVRGLYYYGMDVWGQGTTVTVSSASTKGPSVFPLAPC SRSTSESTAALGCLVKDYFPEPVTVSWNSGALTSGVHTFPAVLQSS GLYSLSSVVTVPSSNFGTQTYTCNVDHKPSNTKVDKTV<u>ERKCCVEC PPCPAPPVAG</u>PSVFLFPPKPKDTLMISRTPEVTCVVVDVSHEDPEV KFNWYVDGVEVHNAKTKPREEQYNSTYRVVSVLTVLHQDWLNGKEY KCKVSNKALPSSIEKTISKAKGQPREPQVYTLPPSREEMTKNQVSL TCLVKGFYPSDIAVEWESNGQPENNYKTTPPVLDSDGSFFLYSKLT VDKSRWQQGNVFSCSVMHEALHNHYTQKSLSLSPG |
| 351 | 6G10 (VH + G2(C219S).g1) or 6G10-IgG2-C219S-IgG1 | QVQLVESGGDVVQPGRSLRLSCAASGFTFSTYGMHWVRQAPGKGLE WVAVTWYAGSNKFYADSVKGRFTISRDNSKNTLYLQMNSLRAEDTA VYYCARGGSMVRGLYYYGMDVWGQGTTVTVSSASTKGPSVFPLAPC SRSTSESTAALGCLVKDYFPEPVTVSWNSGALTSGVHTFPAVLQSS GLYSLSSVVTVPSSNFGTQTYTCNVDHKPSNTKVDKTV<u>ERKSCVEC PPCPAPELLGG</u>PSVFLFPPKPKDTLMISRTPEVTCVVVDVSHEDPE VKFNWYVDGVEVHNAKTKPREEQYNSTYRVVSVLTVLHQDWLNGKE YKCKVSNKALPAPIEKTISKAKGQPREPQVYTLPPSREEMTKNQVS LTCLVKGFYPSDIAVEWESNGQPENNYKTTPPVLDSDGSFFLYSKL TVDKSRWQQGNVFSCSVMHEALHNHYTQKSLSLSPG |
| 352 | 6G10 (VH + G2(C219S).g1.1) or 6G10-IgG2-C219S-IgG1.1 | QVQLVESGGDVVQPGRSLRLSCAASGFTFSTYGMHWVRQAPGKGLE WVAVTWYAGSNKFYADSVKGRFTISRDNSKNTLYLQMNSLRAEDTA VYYCARGGSMVRGLYYYGMDVWGQGTTVTVSSASTKGPSVFPLAPC SRSTSESTAALGCLVKDYFPEPVTVSWNSGALTSGVHTFPAVLQSS GLYSLSSVVTVPSSNFGTQTYTCNVDHKPSNTKVDKTV<u>ERKSCVEC PPCPAPPVAG</u>PSVFLFPPKPKDTLMISRTPEVTCVVVDVSHEDPEV KFNWYVDGVEVHNAKTKPREEQYNSTYRVVSVLTVLHQDWLNGKEY KCKVSNKALP<u>SSI</u>EKTISKAKGQPREPQVYTLPPSREEMTKNQVSL TCLVKGFYPSDIAVEWESNGQPENNYKTTPPVLDSDGSFFLYSKLT VDKSRWQQGNVFSCSVMHEALHNHYTQKSLSLSPG |
| 353 | 6G10 (VH) nucleotide sequence | CAGGTGCAGCTGGTGGAGTCTGGGGGAGACGTGGTCCAGCCTGGGA GGTCCCTGAGACTCTCCTGTGCAGCGTCTGGATTCACCTTCAGTAC CTATGGCATGCACTGGGTCCGCCAGGCTCCAGGCAAGGGGCTGGAG TGGGTGGCAGTTACATGGTATGCTGGAAGTAATAAATTTTATGCAG ACTCCGTGAAGGGCCGATTCACCATCTCCAGAGACAATTCCAAGAA CACGCTGTATCTGCAAATGAACAGCCTGAGAGCCGAGGACACGGCT GTGTATTACTGTGCGAGAGGAGGTAGTATGGTTCGGGGACTTTATT ATTACGGTATGGACGTCTGGGGCCAAGGGACCACGGTCACCGTCTC CTCA |
| 354 | 6G10 (VL) nucleotide sequence | GCCATCCAGTTGACCCAGTCTCCATCCTCCCTGTCTGCATCTGTAG GAGACAGAGTCACCATCACTTGCCGGGCAAGTCAGGGCATTAGCAG TGCTTTAGCCTGGTATCAGCAGAAACCAGGGAAAGCTCCTAAGCTC CTGATCTATGATGCCTCCAGTTTGGAAAGTGGGGTCCCATCAAGGT TCAGCGGCAGTGGATCTGGGACAGATTTCACTCTCACCATCAGCAG CCTGCAGCCTGAAGATTTTGCAACTTATTACTGTCAACAGTTTAAT AGTTACCCGTACACTTTTGGCCAGGGGACCAAGCTGGAGATCAAA |
| 355 | 6G10 (full length wild-type heavy chain) nucleotide sequence The sequence encoding the constant region is underlined | CAGGTGCAGCTGGTGGAGTCTGGGGGAGACGTGGTCCAGCCTGGGA GGTCCCTGAGACTCTCCTGTGCAGCGTCTGGATTCACCTTCAGTAC CTATGGCATGCACTGGGTCCGCCAGGCTCCAGGCAAGGGGCTGGAG TGGGTGGCAGTTACATGGTATGCTGGAAGTAATAAATTTTATGCAG ACTCCGTGAAGGGCCGATTCACCATCTCCAGAGACAATTCCAAGAA CACGCTGTATCTGCAAATGAACAGCCTGAGAGCCGAGGACACGGCT GTGTATTACTGTGCGAGAGGAGGTAGTATGGTTCGGGGACTTTATT ATTACGGTATGGACGTCTGGGGCCAAGGGACCACGGTCACCGTCTC CTCA<u>GCCTCCACCAAGGGCCCATCGGTCTTCCCCCTGGCGCCCTGC TCCAGGAGCACCTCCGAGAGCACAGCGGCCCTGGGCTGCCTGGTCA</u> |

TABLE 15-continued

SUMMARY OF SEQUENCE LISTING

| SEQ ID | Description | Sequence |
|---|---|---|
| | | AGGACTACTTCCCCGAACCGGTGACGGTGTCGTGGAACTCAGGCGC<br>TCTGACCAGCGGCGTGCACACCTTCCCAGCTGTCCTACAGTCCTCA<br>GGACTCTACTCCCTCAGCAGCGTGGTGACCGTGCCCTCCAGCAACT<br>TCGGCACCCAGACCTACACCTGCAACGTAGATCACAAGCCCAGCAA<br>CACCAAGGTGGACAAGACAGTTGAGCGCAAATGTTGTGTCGAGTGC<br>CCACCGTGCCCAGCACCACCTGTGGCAGGACCGTCAGTCTTCCTCT<br>TCCCCCCAAAACCCAAGGACACCCTCATGATCTCCCGGACCCCTGA<br>GGTCACGTGCGTGGTGGTGGACGTGAGCCACGAAGACCCCGAGGTC<br>CAGTTCAACTGGTACGTGGACGGCGTGGAGGTGCATAATGCCAAGA<br>CAAAGCCACGGGAGGAGCAGTTCAACAGCACGTTCCGTGTGGTCAG<br>CGTCCTCACCGTTGTGCACCAGGACTGGCTGAACGGCAAGGAGTAC<br>AAGTGCAAGGTCTCCAACAAAGGCCTCCCAGCCCCCATCGAGAAAA<br>CCATCTCCAAAACCAAAGGGCAGCCCCGAGAACCACAGGTGTACAC<br>CCTGCCCCCATCCCGGGAGGAGATGACCAAGAACCAGGTCAGCCTG<br>ACCTGCCTGGTCAAAGGCTTCTACCCCAGCGACATCGCCGTGGAGT<br>GGGAGAGCAATGGGCAGCCGGAGAACAACTACAAGACCACACCTCC<br>CATGCTGGACTCCGACGGCTCCTTCTTCCTCTACAGCAAGCTCACC<br>GTGGACAAGAGCAGGTGGCAGCAGGGGAACGTCTTCTCATGCTCCG<br>TGATGCATGAGGCTCTGCACAACCACTACACGCAGAAGAGCCTCTC<br>CCTGTCTCCGGGTAAA |
| 356 | 6G10 (full length wild-type light chain) nucleotide sequence The sequence enconding the constant region is underlined | GCCATCCAGTTGACCCAGTCTCCATCCTCCCTGTCTGCATCTGTAG<br>GAGACAGAGTCACCATCACTTGCCGGGCAAGTCAGGGCATTAGCAG<br>TGCTTTAGCCTGGTATCAGCAGAAACCAGGGAAAGCTCCTAAGCTC<br>CTGATCTATGATGCCTCCAGTTTGGAAAGTGGGGTCCCATCAAGGT<br>TCAGCGGCAGTGGATCTGGGACAGATTTCACTCTCACCATCAGCAG<br>CCTGCAGCCTGAAGATTTTGCAACTTATTACTGTCAACAGTTTAAT<br>AGTTACCCGTACACTTTTGGCCAGGGGACCAAGCTGGAGATCAAA<u>C<br>GAACTGTGGCTGCACCATCTGTCTTCATCTTCCCGCCATCTGATGA<br>GCAGTTGAAATCTGGAACTGCCTCTGTTGTGTGCCTGCTGAATAAC<br>TTCTATCCCAGAGAGGCCAAAGTACAGTGGAAGGTGGATAACGCCC<br>TCCAATCGGGTAACTCCCAGGAGAGTGTCACAGAGCAGGACAGCAA<br>GGACAGCACCTACAGCCTCAGCAGCACCCTGACGCTGAGCAAAGCA<br>GACTACGAGAAACACAAAGTCTACGCCTGCGAAGTCACCCATCAGG<br>GCCTGAGCTCGCCCGTCACAAAGAGCTTCAACAGGGGAGAGTGT</u> |
| 357 | 28F3 (VH) (SEQ ID NO: 13) with signal peptide The signal peptide is underlined | <u>MRAWIFFLLCLAGRALA</u>QVQLVESGGGVVQPGRSLRLSCAASGFTF<br>SSYGMHWVRQAPGKGLEWVAVIWYEGSNKYYADSVKGRFTISRDNS<br>KNTLYLQMNSLRAEDTAVYYCARGGSMVRGDYYYGMDVWGQGTTVT<br>VSS |
| 358 | 28F3 (VL) (SEQ ID NO: 14) with signal peptide The signal peptide is underlined | <u>MRAWIFFLLCLAGRALA</u>AIQLTQSPSSLSASVGDRVTITCRASQGI<br>SSALAWYQQKPGKAPKLLIYDASSLESGVPSRFSGSGSGTDFTLTI<br>SSLQPEDFATYYCQQFNSYPYTFGQGTKLEIK |
| 359 | 28F3 (VH) with signal peptide nucleotide sequence SEQ ID NO: 147 with sequence encoding signal peptide The sequence encoding the signal peptide is underlined | <u>atgagggcttggatcttctttctgctctgcctggccgggagagcgc<br>tcgca</u>CAGGTGCAGCTGGTGGAGTCTGGGGGAGGCGTGGTCCAGCC<br>TGGGAGGTCCCTGAGACTCTCCTGTGCAGCGTCGGATTCACCTTC<br>AGTAGCTATGGCATGCACTGGGTCCGCCAGGCTCCAGGCAAGGGGC<br>TGGAGTGGGTGGCAGTTATATGGTATGAAGGAAGTAATAAATATTA<br>TGCAGACTCCGTGAAGGGCCGATTCACCATCTCCAGAGACAATTCC<br>AAGAACACGCTGTATCTGCAAATGAACAGCCTGAGAGCCGAGGACA<br>CGGCTGTGTATTACTGTGCGAGAGGGGGAGTATGGTTCGGGGGGA<br>CTACTACTACGGTATGGACGTCTGGGGCCAAGGGACCACGGTCACC<br>GTCTCCTCA |
| 360 | 28F3 (VL) with signal peptide nucleotide sequence SEQ ID NO: 148 with sequence encoding signal peptide The sequence encoding the signal peptide is underlined | <u>atgagggcttggatcttctttctgctctgcctggccgggcgcgcct<br>tcgcc</u>GCCATCCAGTTGACCCAGTCTCCATCCTCCCTGTCTGCATC<br>TGTAGGAGACAGAGTCACCATCACTTGCCGGGCAAGTCAGGGCATT<br>AGCAGTGCTTTAGCCTGGTATCAGCAGAAACCAGGGAAAGCTCCTA<br>AGCTCCTGATCTATGATGCCTCCAGTTTGGAAAGTGGGGTCCCATC<br>AAGGTTCAGCGGCAGTGGATCTGGGACAGATTTCACTCTCACCATC<br>AGCAGCCTGCAGCCTGAAGATTTTGCAACTTATTACTGTCAACAGT<br>TTAATAGTTACCCGTACACTTTTGGCCAGGGGACCAAGCTGGAGAT<br>CAAA |
| 361 | 28F3.IgG1 (VH + IgG1) (SEQ ID NO: 17) with signal peptide The signal peptide and constant region are underlined | <u>MRAWIFFLLCLAGRALA</u>QVQLVESGGGVVQPGRSLRLSCAASGFTF<br>SSYGMHWVRQAPGKGLEWVAVIWYEGSNKYYADSVKGRFTISRDNS<br>KNTLYLQMNSLRAEDTAVYYCARGGSMVRGDYYYGMDVWGQGTTVT<br>VSS<u>ASTKGPSVFPLAPSSKSTSGGTAALGCLVKDYFPEPVTVSWNS<br>GALTSGVHTFPAVLQSSGLYSLSSVVTVPSSSLGTQTYICNVNHKP<br>SNTKVDKRVEPKSCDKTHTCPPCPAPELLGGPSVFLFPPKPKDTLM<br>ISRTPEVTCVVVDVSHEDPEVKFNWYVDGVEVHNAKTKPREEQYNS<br>TYRVVSVLTVLHQDWLNGKEYKCKVSNKALPAPIEKTISKAKGQPR<br>EPQVYTLPPSREEMTKNQVSLTCLVKGFYPSDIAVEWESNGQPENN</u> |

TABLE 15-continued

SUMMARY OF SEQUENCE LISTING

| SEQ ID | Description | Sequence |
|---|---|---|
| | | YKTTPPVLDSDGSFFLYSKLTVDKSRWQQGNVFSCSVMHEALHNHY<br>TQKSLSLSPG |
| 362 | 28F3.IgG1.1 (VH + IgG1.1) (SEQ ID NO: 18) with signal peptide<br>The signal peptide and constant region are underlined | <u>MRAWIFFLLCLAGRALA</u>QVQLVESGGGVVQPGRSLRLSCAASGFTF<br>SSYGMHWVRQAPGKGLEWVAVIWYEGSNKYYADSVKGRFTISRDNS<br>KNTLYLQMNSLRAEDTAVYYCARGGSMVRGDYYYGMDVWGQGTTVT<br>VSS<u>ASTKGPSVFPLAPSSKSTSGGTAALGCLVKDYFPEPVTVSWNS<br>GALTSGVHTFPAVLQSSGLYSLSSVVTVPSSSLGTQTYICNVNHKP<br>SNTKVDKRVEPKSCDKTHTCPPCPAPEAEGAPSVFLFPPKPKDTLM<br>ISRTPEVTCVVVDVSHEDPEVKFNWYVDGVEVHNAKTKPREEQYNS<br>TYRVVSVLTVLHQDWLNGKEYKCKVSNKALPSSIEKTISKAKGQPR<br>EPQVYTLPPSREEMTKNQVSLTCLVKGFYPSDIAVEWESNGQPENN<br>YKTTPPVLDSDGSFFLYSKLTVDKSRWQQGNVFSCSVMHEALHNHY<br>TQKSLSLSPG</u> |
| 363 | 28F3.IgG1 (VH + IgG1) with signal peptide nucleotide sequence SEQ ID NO: 151 with sequence encoding signal peptide<br>The sequence encoding the signal peptide is underlined | <u>atgaggqcttggatcttctttctgctctgcctggccgggagagc<br>gctcgca</u>caggtgcagctggtggagtctgggggaggcgtggtcca<br>gcctggggaggtccctgagactctcctgtgcagcgtctggattcacc<br>ttcagtagctatggcatgcactgggtccgccaggctccaggcaagg<br>ggctggagtgggtggcagttatatggtatgaaggaagtaataaata<br>ttatgcagactccgtgaagggccgattcaccatctccagagacaat<br>tccaagaacacgctgtatctgcaaatgaacagcctgagagccgagg<br>acacggctgtgtattactgtgcgagaggggggagtatggttcgggg<br>ggactactactacggtatggacgtctggggccaagggaccacggtc<br>accgtctcctcagctagcaccaagggcccatcggtcttccccctgg<br>caccctcctccaagagcacctctgggggcacagcggccctgggctg<br>cctggtcaaggactacttccccgaaccggtgacggtgtcgtggaac<br>tcaggcgccctgaccagcggcgtgcacaccttcccggctgtcctac<br>agtcctcaggactctactccctcagcagcgtggtgaccgtgccctc<br>cagcagcttgggcacccagacctacatctgcaacgtgaatcacaag<br>cccagcaacaccaaggtggacaagagagttgagcccaaatcttgtg<br>acaaaactcacacatgcccaccgtgcccagcacctgaactcctggg<br>gggaccgtcagtcttcctcttccccccaaaacccaaggacaccctc<br>atgatctcccggacccctgaggtcacatgcgtggtggtggacgtga<br>gccacgaagaccctgaggtcaagttcaactggtacgtggacggcgt<br>ggaggtgcataatgccaagacaaagccgcgggaggagcagtacaac<br>agcacgtaccgtgtggtcagcgtcctcaccgtcctgcaccaggact<br>ggctgaatggcaaggagtacaagtgcaaggtctccaacaaagccct<br>cccagcccccatcgagaaaaccatctccaaagccaaagggcagccc<br>cgagaaccacaggtgtacaccctgcccccatcccgggaggagatga<br>ccaagaaccaggtcagcctgacctgcctggtcaaaggcttctatcc<br>cagcgacatcgccgtggagtgggagagcaatgggcagccggagaac<br>aactacaagaccacgcctcccgtgctggactccgacggctccttct<br>tcctctatagcaagctcaccgtggacaagagcaggtggcagcaggg<br>gaacgtcttctcatgctccgtgatgcatgaggctctgcacaaccac<br>tacacgcagaagagcctctccctgtccccgggttga |
| 364 | 28F3.IgG1.1 (VH + IgG1.1) with signal peptide nucleotide sequence SEQ ID NO: 152 with sequence encoding signal peptide<br>The sequence encoding the signal peptide is underlined | <u>atgaggqcttggatcttctttctgctctgcctggccgggagagc<br>gctcgca</u>caggtgcagc tggtggagtc tgggggaggc<br>gtggtccagc ctggggaggtc cctgagactc tcctgtgcag<br>cgtctggatt caccttcagt agctatggca tgcactgggt<br>ccgccaggct<br>ccaggcaagg ggctggagtg ggtggcagtt atatggtatg<br>aaggaagtaa taaatattat gcagactccg tgaagggccg<br>attcaccatc tccagagaca attccaagaa cacgctgtat<br>ctgcaaatga acagcctgag agccgaggac acggctgtgt<br>attactgtgc gagagggggg agtatggttc gggggggacta<br>ctactacggt atggacgtct ggggccaagg gaccacggtc<br>accgtctcct cagctagcac caagggccca tcggtcttcc<br>ccctggcacc ctcctccaag agcacctctg ggggcacagc<br>ggccctgggc tgcctggtca aggactactt ccccgaaccg<br>gtgacggtgt cgtggaactc aggcgccctg accagcggcg<br>tgcacacctt cccggctgtc ctacagtcct caggactcta<br>ctccctcagc agcgtggtga ccgtgccctc cagcagcttg<br>ggcacccaga cctacatctg caacgtgaat cacaagccca<br>gcaacaccaa ggtggacaag agagttgagc ccaaatcttg<br>tgacaaaact cacacatgcc caccgtgccc agcacctgaa<br>gccgaagggg cccgtcagt cttcctcttc cccccaaaac<br>ccaaggacac cctcatgatc tcccggaccc ctgaggtcac<br>atgcgtggtg gtggacgtga gccacgaaga ccctgaggtc<br>aagttcaact ggtacgtgga cggcgtggag gtgcataatg<br>ccaagacaaa gccgcgggag gagcagtaca acagcacgta<br>ccgtgtggtc agcgtcctca ccgtcctgca ccaggactgg<br>ctgaatggca aggagtacaa gtgcaaggtc tccaacaaag<br>ccctcccaag cagcatcgag aaaaccatct ccaaagccaa |

TABLE 15-continued

SUMMARY OF SEQUENCE LISTING

| SEQ ID | Description | Sequence |
|---|---|---|
| | | agggcagccc cgagaaccac aggtgtacac cctgccccca<br>tcccgggagg agatgaccaa gaaccaggtc agcctgacct<br>gcctggtcaa aggcttctat cccagcgaca tcgccgtgga<br>gtgggagagc aatgggcagc cggagaacaa ctacaagacc<br>acgcctcccg tgctggactc cgacggctcc ttcttcctct<br>atagcaagct caccgtggac aagagcaggt ggcagcaggg<br>gaacgtcttc tcatgctccg tgatgcatga ggctctgcac<br>aaccactaca cgcagaagag cctctccctg tccccgggtt ga |
| 365 | 28F3.IgG1 (VL + CL) (SEQ ID NO: 19) with signal peptide<br>The signal peptide and constant region are underlined | <u>MRAWIFFLLCLAGRALAA</u>IQLTQSPSSLSASVGDRVTITCRASQ<br>GISSALAWYQQKPGKAPKLLIYDASSLESGVPSRFSGSGSGTDF<br>TLTISSLQPEDFATYYCQQFNSYPYTFGQGTKLEIK<u>RTVAAPSV<br>FIFPPSDEQLKSGTASVVCLLNNFYPREAKVQWKVDNALQSGNS<br>QESVTEQDSKDSTYSLSSTLTLSKADYEKHKVYACEVTHQGLSS<br>PVTKSFNRGEC</u> |
| 366 | 28F3.IgG1 (VL + CL) with signal peptide nucleotide sequence<br>SEQ ID NO: 153 with signal sequence<br>The sequence encoding the signal peptide is underlined | <u>atgagggcttggatcttctttctgctctgcctggccgggcgcgc<br>cttggccgcc</u>atccagttgacccagtctccatcctccctgtctgc<br>atctgtaggagacagagtcaccatcacttgccgggcaagtcagggc<br>attagcagtgctttagcctggtatcagcagaaaccagggaaagctc<br>ctaagctcctgatctatgatgcctccagtttggaaagtggggtccc<br>atcaaggttcagcggcagtggatctgggacagatttcactctcacc<br>atcagcagcctgcagcctgaagattttgcaacttattactgtcaac<br>agtttaatagttacccgtacacttttggccaggggaccaagctgga<br>gatcaaacgtacggtggctgcaccatctgtcttcatcttcccgcca<br>tctgatgagcagttgaaatctggaactgcctctgttgtgtgcctgc<br>tgaataacttctatcccagagaggccaaagtacagtggaaggtgga<br>taacgccctccaatcgggtaactcccaggagagtgtcacagagcag<br>gacagcaaggacagcacctacagcctcagcagcaccctgacgctga<br>gcaaagcagactacgagaaacacaaagtctacgcctgcgaagtcac<br>ccatcagggcctgagctcgcccgtcacaaagagcttcaacaggg<br>gagagtgttag |
| 367 | Signal peptide | MRAWIFFLLCLAGRALA |
| 368 | Signal peptide nucleotide sequence | atgagggcttggatcttctttctgctctgcctggccgggagagcgc<br>tgca |
| 369 | Signal peptide nucleotide sequence | atgagggcttggatcttctttctgctctgcctggccgggcgcgcct<br>tggcc |
| 370 | Human GITR fragment | QRPTGGPGCGPGRLLLGTGTDARCCRVHTTR |
| 371 | 9G7 L1 (full length wild-type light chain 1)<br>The constant region is underlined | EIVLTQSPGTLSLSPGERATLSCRASQSVSSSYLAWYQQKPGQAPR<br>LLIYGASSRATGIPDRFSGSGSGTDFTLTISRLEPEDFAVYYCQQY<br>GSSPWTFGQGTKVEIK<u>RTVAAPSVFIFPPSDEQLKSGTASVVCLLN<br>NFYPREAKVQWKVDNALQSGNSQESVTEQDSKDSTYSLSSTLTLSK<br>ADYEKHKVYACEVTHQGLSSPVTKSFNRGEC</u> |
| 372 | degenerate VH CDR1 | SYGXH, wherein X is any amino acid |
| 373 | degenerate VH CDR2 | VIWYX$_1$GSNKX$_2$YADSVKG, wherein X$_1$ and X$_2$ are any amino acids |
| 374 | degenerate VH CDR2 | VIWYX$_1$GSNKX$_2$YX$_3$DSVKG, wherein X$_1$, X$_2$, and X$_3$ are any amino acids |
| 375 | degenerate VH CDR3 | GGSX$_1$VRGDYYYGMDV, wherein X$_1$ is any amino acid |
| 376 | degenerate VH CDR3 | GGSX$_1$VRGX$_2$YYYGMDV, wherein X$_1$ and X$_2$ are any amino acids |
| 377 | degenerate VH CDR3 | GG (6-7aa) MDVWYYX$_1$MDVW, wherein X$_1$ is any amino acid, and the 6-7 amino acids are any amino acids |
| 378 | degenerate VL CDR1 | RASQGISSXLA, wherein X is any amino acid |
| 379 | degenerate VL CDR1 | RASQG (2-3 aa) SX$_1$LA, wherein X1 is any amino acid, and the 2-3 amino acids are any amino acids |

TABLE 15-continued

SUMMARY OF SEQUENCE LISTING

| SEQ ID | Description | Sequence |
|---|---|---|
| 380 | degenerate VL CDR2 | DASSLXS, wherein X is any amino acid |
| 381 | degenerate VL CDR3 | QQXNSYPYT, wherein X is any amino acid |
| 382 | degenerate VL CDR3 | QQX$_1$X$_2$SX$_3$PX$_4$T, wherein X$_1$, X$_2$, X$_3$, and X$_4$ are any amino acids |
| 383 | IgG1f | ASTKGPSVFPLAPSSKSTSGGTAALGCLVKDYFPEPVTVSWNSG<br>ALTSGVHTFPAVLQSSGLYSLSSVVTVPSSSLGTQTYICNVNHK<br>PSNTKVDKRVEPKSCDKTHTCPPCPAPELLGGPSVFLFPPKPKD<br>TLMISRTPEVTCVVVDVSHEDPEVKFNWYVDGVEVHNAKTKPRE<br>EQYNSTYRVVSVLTVLHQDWLNGKEYKCKVSNKALPAPIEKTIS<br>KAKGQPREPQVYTLPPSREEMTKNQVSLTCLVKGFYPSDIAVEW<br>ESNGQPENNYKTTPPVLDSDGSFFLYSKLTVDKSRWQQGNVFSC<br>SVMHEALHNHYTQKSLSLSPGK |
| 384 | IgG2.3 | ASTKGPSVFPLAPCSRSTSESTAALGCLVKDYFPEPVTVSWNSG<br>ALTSGVHTFPAVLQSSGLYSLSSVVTVPSSNFGTQTYTCNVDHK<br>PSNTKVDKTVERKSCVECPPCPAPPVAGPSVFLFPPKPKDTLMI<br>SRTPEVTCVVVDVSHEDPEVQFNWYVDGVEVHNAKTKPREEQFN<br>STFRVVSVLTVVHQDWLNGKEYKCKVSNKGLPAPIEKTISKTKG<br>QPREPQVYTLPPSREEMTKNQVSLTCLVKGFYPSDIAVEWESNG<br>QPENNYKTTPPMLDSDGSFFLYSKLTVDKSRWQQGNVFSCSVMH<br>EALHNHYTQKSLSLSPGK |
| 385 | IgG2.3G1-AY | ASTKGPSVFPLAPCSRSTSESTAALGCLVKDYFPEPVTVSWNSG<br>ALTSGVHTFPAVLQSSGLYSLSSVVTVPSSNFGTQTYTCNVDHK<br>PSNTKVDKTVERKSCVECPPCPAPELLGGPSVFLFPPKPKDTLM<br>ISRTPEVTCVVVDVSHEDPEVKFNWYVDGVEVHNAKTKPREEQY<br>NSTYRVVSVLTVLHQDWLNGKEYKCKVSNKALPAPIEKTISKAK<br>GQPREPQVYTLPPSREEMTKNQVSLTCLVKGFYPSDIAVEWESN<br>GQPENNYKTTPPVLDSDGSFFLYSKLTVDKSRWQQGNVFSCSVM<br>HEALHNHYTQKSLSLSPGK |
| 386 | IgG2.3G1-KH | ASTKGPSVFPLAPCSRSTSESTAALGCLVKDYFPEPVTVSWNSG<br>ALTSGVHTFPAVLQSSGLYSLSSVVTVPSSNFGTQTYTCNVDHK<br>PSNTKVDKTVERKSCVECPPCPAPPVAGPSVFLFPPKPKDTLMI<br>SRTPEVTCVVVDVSHEDPEVKFNWYVDGVEVHNAKTKPREEQYN<br>STYRVVSVLTVLHQDWLNGKEYKCKVSNKALPAPIEKTISKAKG<br>QPREPQVYTLPPSREEMTKNQVSLTCLVKGFYPSDIAVEWESNG<br>QPENNYKTTPPVLDSDGSFFLYSKLTVDKSRWQQGNVFSCSVMH<br>EALHNHYTQKSLSLSPGK |
| 387 | IgG2.5 | ASTKGPSVFPLAPSSRSTSESTAALGCLVKDYFPEPVTVSWNSG<br>ALTSGVHTFPAVLQSSGLYSLSSVVTVPSSNFGTQTYTCNVDHK<br>PSNTKVDKTVERKCCVECPPCPAPPVAGPSVFLFPPKPKDTLMI<br>SRTPEVTCVVVDVSHEDPEVQFNWYVDGVEVHNAKTKPREEQFN<br>STFRVVSVLTVVHQDWLNGKEYKCKVSNKGLPAPIEKTISKTKG<br>QPREPQVYTLPPSREEMTKNQVSLTCLVKGFYPSDIAVEWESNG<br>QPENNYKTTPPMLDSDGSFFLYSKLTVDKSRWQQGNVFSCSVMH<br>EALHNHYTQKSLSLSPGK |
| 388 | IgG1.1f | ASTKGPSVFPLAPSSKSTSGGTAALGCLVKDYFPEPVTVSWNSG<br>ALTSGVHTFPAVLQSSGLYSLSSVVTVPSSSLGTQTYICNVNHK<br>PSNTKVDKRVEPKSCDKTHTCPPCPAPEAEGAPSVFLFPPKPKD<br>TLMISRTPEVTCVVVDVSHEDPEVKFNWYVDGVEVHNAKTKPRE<br>EQYNSTYRVVSVLTVLHQDWLNGKEYKCKVSNKALPSSIEKTIS<br>KAKGQPREPQVYTLPPSREEMTKNQVSLTCLVKGFYPSDIAVEW<br>ESNGQPENNYKTTPPVLDSDGSFFLYSKLTVDKSRWQQGNVFSC<br>SVMHEALHNHYTQKSLSLSPGK |
| 389 | IgG2.3G1.1f-KH | ASTKGPSVFPLAPCSRSTSESTAALGCLVKDYFPEPVTVSWNSG<br>ALTSGVHTFPAVLQSSGLYSLSSVVTVPSSNFGTQTYTCNVDHK<br>PSNTKVDKTVERKSCVECPPCPAPPVAGPSVFLFPPKPKDTLMI<br>SRTPEVTCVVVDVSHEDPEVKFNWYVDGVEVHNAKTKPREEQYN<br>STYRVVSVLTVLHQDWLNGKEYKCKVSNKALPSSIEKTISKAKG<br>QPREPQVYTLPPSREEMTKNQVSLTCLVKGFYPSDIAVEWESNG<br>QPENNYKTTPPVLDSDGSFFLYSKLTVDKSRWQQGNVFSCSVMH<br>EALHNHYTQKSLSLSPGK |
| 390 | IgG1-deltaTHT | ASTKGPSVFPLAPSSKSTSGGTAALGCLVKDYFPEPVTVSWNSG<br>ALTSGVHTFPAVLQSSGLYSLSSVVTVPSSSLGTQTYICNVNHK<br>PSNTKVDKRVEPKSCDKCPPCPAPELLGGPSVFLFPPKPKDTLM<br>ISRTPEVTCVVVDVSHEDPEVKFNWYVDGVEVHNAKTKPREEQY<br>NSTYRVVSVLTVLHQDWLNGKEYKCKVSNKALPAPIEKTISKAK |

TABLE 15-continued

SUMMARY OF SEQUENCE LISTING

| SEQ ID | Description | Sequence |
|---|---|---|
| | | GQPREPQVYTLPPSREEMTKNQVSLTCLVKGFYPSDIAVEWESN GQPENNYKTTPPVLDSDGSFFLYSKLTVDKSRWQQGNVFSCSVM HEALHNHYTQKSLSLSPGK |
| 391 | IgG2.3-plusTHT | ASTKGPSVFPLAPCSRSTSESTAALGCLVKDYFPEPVTVSWNSG ALTSGVHTFPAVLQSSGLYSLSSVVTVPSSNFGTQTYTCNVDHK PSNTKVDKTVERKSCVETHTCPPCPAPPVAGPSVFLFPPKPKDT LMISRTPEVTCVVVDVSHEDPEVQFNWYVDGVEVHNAKTKPREE QFNSTFRVVSVLTVVHQDWLNGKEYKCKVSNKGLPAPIEKTISK TKGQPREPQVYTLPPSREEMTKNQVSLTCLVKGFYPSDIAVEWE SNGQPENNYKTTPPMLDSDGSFFLYSKLTVDKSRWQQGNVFSCS VMHEALHNHYTQKSLSLSPGK |
| 392 | IgG2.3-plusGGG | ASTKGPSVFPLAPCSRSTSESTAALGCLVKDYFPEPVTVSWNSG ALTSGVHTFPAVLQSSGLYSLSSVVTVPSSNFGTQTYTCNVDHK PSNTKVDKTVERKSCVEGGGCPPCPAPPVAGPSVFLFPPKPKDT LMISRTPEVTCVVVDVSHEDPEVQFNWYVDGVEVHNAKTKPREE QFNSTFRVVSVLTVVHQDWLNGKEYKCKVSNKGLPAPIEKTISK TKGQPREPQVYTLPPSREEMTKNQVSLTCLVKGFYPSDIAVEWE SNGQPENNYKTTPPMLDSDGSFFLYSKLTVDKSRWQQGNVFSCS VMHEALHNHYTQKSLSLSPGK |
| 393 | IgG2.5G1.1f-KH | ASTKGPSVFPLAPSSRSTSESTAALGCLVKDYFPEPVTVSWNSG ALTSGVHTFPAVLQSSGLYSLSSVVTVPSSNFGTQTYTCNVDHK PSNTKVDKTVERKCCVECPPCPAPPVAGPSVFLFPPKPKDTLMI SRTPEVTCVVVDVSHEDPEVKFNWYVDGVEVHNAKTKPREEQYN STYRVVSVLTVLHQDWLNGKEYKCKVSNKALPSSIEKTISKAKG QPREPQVYTLPPSREEMTKNQVSLTCLVKGFYPSDIAVEWESNG QPENNYKTTPPVLDSDGSFFLYSKLTVDKSRWQQGNVFSCSVMH EALHNHYTQKSLSLSPGK |
| 394 | IgG2.5G1-AY | ASTKGPSVFPLAPSSRSTSESTAALGCLVKDYFPEPVTVSWNSG ALTSGVHTFPAVLQSSGLYSLSSVVTVPSSNFGTQTYTCNVDHK PSNTKVDKTVERKCCVECPPCPAPELLGGPSVFLFPPKPKDTLM ISRTPEVTCVVVDVSHEDPEVKFNWYVDGVEVHNAKTKPREEQY NSTYRVVSVLTVLHQDWLNGKEYKCKVSNKALPAPIEKTISKAK GQPREPQVYTLPPSREEMTKNQVSLTCLVKGFYPSDIAVEWESN GQPENNYKTTPPVLDSDGSFFLYSKLTVDKSRWQQGNVFSCSVM HEALHNHYTQKSLSLSPGK |
| 395 | IgG2.5G1-KH | ASTKGPSVFPLAPSSRSTSESTAALGCLVKDYFPEPVTVSWNSG ALTSGVHTFPAVLQSSGLYSLSSVVTVPSSNFGTQTYTCNVDHK PSNTKVDKTVERKCCVECPPCPAPPVAGPSVFLFPPKPKDTLMI SRTPEVTCVVVDVSHEDPEVKFNWYVDGVEVHNAKTKPREEQYN STYRVVSVLTVLHQDWLNGKEYKCKVSNKALPAPIEKTISKAKG QPREPQVYTLPPSREEMTKNQVSLTCLVKGFYPSDIAVEWESNG QPENNYKTTPPVLDSDGSFFLYSKLTVDKSRWQQGNVFSCSVMH EALHNHYTQKSLSLSPGK |
| 396 | IgG2.5-plusTHT | ASTKGPSVFPLAPSSRSTSESTAALGCLVKDYFPEPVTVSWNSG ALTSGVHTFPAVLQSSGLYSLSSVVTVPSSNFGTQTYTCNVDHK PSNTKVDKTVERKCCVETHTCPPCPAPPVAGPSVFLFPPKPKDT LMISRTPEVTCVVVDVSHEDPEVQFNWYVDGVEVHNAKTKPREE QFNSTFRVVSVLTVVHQDWLNGKEYKCKVSNKGLPAPIEKTISK TKGQPREPQVYTLPPSREEMTKNQVSLTCLVKGFYPSDIAVEWE SNGQPENNYKTTPPMLDSDGSFFLYSKLTVDKSRWQQGNVFSCS VMHEALHNHYTQKSLSLSPGK |
| 397 | IgG1-G2.3G1-AY | ASTKGPSVFPLAPSSKSTSGGTAALGCLVKDYFPEPVTVSWNSG ALTSGVHTFPAVLQSSGLYSLSSVVTVPSSSLGTQTYICNVNHK PSNTKVDKRVERKSCVECPPCPAPELLGGPSVFLFPPKPKDTLM ISRTPEVTCVVVDVSHEDPEVKFNWYVDGVEVHNAKTKPREEQY NSTYRVVSVLTVLHQDWLNGKEYKCKVSNKALPAPIEKTISKAK GQPREPQVYTLPPSREEMTKNQVSLTCLVKGFYPSDIAVEWESN GQPENNYKTTPPVLDSDGSFFLYSKLTVDKSRWQQGNVFSCSVM HEALHNHYTQKSLSLSPGK |
| 398 | IgG1-G2.3G1-KH | ASTKGPSVFPLAPSSKSTSGGTAALGCLVKDYFPEPVTVSWNSG ALTSGVHTFPAVLQSSGLYSLSSVVTVPSSSLGTQTYICNVNHK PSNTKVDKRVERKSCVECPPCPAPPVAGPSVFLFPPKPKDTLMI SRTPEVTCVVVDVSHEDPEVKFNWYVDGVEVHNAKTKPREEQYN STYRVVSVLTVLHQDWLNGKEYKCKVSNKALPAPIEKTISKAKG QPREPQVYTLPPSREEMTKNQVSLTCLVKGFYPSDIAVEWESNG QPENNYKTTPPVLDSDGSFFLYSKLTVDKSRWQQGNVFSCSVMH EALHNHYTQKSLSLSPGK |

TABLE 15-continued

SUMMARY OF SEQUENCE LISTING

| SEQ ID | Description | Sequence |
|---|---|---|
| 399 | G2-G1-G1-G1<br>CH1 domain of IgG2, with all else IgG1 | ASTKGPSVFPLAPCSRSTSESTAALGCLVKDYFPEPVTVSWNSGAL TSGVHTFPAVLQSSGLYSLSSVVTVPSSNFGTQTYTCNVDHKPSNT KVDKTVERKSCDKTHTCPPCPAPELLGGPSVFLFPPKPKDTLMISR TPEVTCVVVDVSHEDPEVKFNWYVDGVEVHNAKTKPREEQYNSTYR VVSVLTVLHQDWLNGKEYKCKVSNKALPAPIEKTISKAKGQPREPQ VYTLPPSREEMTKNQVSLTCLVKGFYPSDIAVEWESNGQPENNYKT TPPVLDSDGSFFLYSKLTVDKSRWQQGNVFSCSVMHEALHNHYTQK SLSLSPGK |
| 400 | G2.5-G1-G1-G1<br>CH1 domain of IgG2, with all else IgG1 | ASTKGPSVFPLAPSSRSTSESTAALGCLVKDYFPEPVTVSWNSGAL TSGVHTFPAVLQSSGLYSLSSVVTVPSSNFGTQTYTCNVDHKPSNT KVDKTVERKSCDKTHTCPPCPAPELLGGPSVFLFPPKPKDTLMISR TPEVTCVVVDVSHEDPEVKFNWYVDGVEVHNAKTKPREEQYNSTYR VVSVLTVLHQDWLNGKEYKCKVSNKALPAPIEKTISKAKGQPREPQ VYTLPPSREEMTKNQVSLTCLVKGFYPSDIAVEWESNGQPENNYKT TPPVLDSDGSFFLYSKLTVDKSRWQQGNVFSCSVMHEALHNHYTQK SLSLSPGK |
| 401 | G1-G2.3-G2-G2<br>CH1 domain of IgG1 with all else IgG2.3 | ASTKGPSVFPLAPSSKSTSGGTAALGCLVKDYFPEPVTVSWNSGAL TSGVHTFPAVLQSSGLYSLSSVVTVPSSSLGTQTYICNVNHKPSNT KVDKRVEPKSCVECPPCPAPPVAGPSVFLFPPKPKDTLMISRTPEV TCVVVDVSHEDPEVQFNWYVDGVEVHNAKTKPREEQFNSTFRVVSV LTVVHQDWLNGKEYKCKVSNKGLPAPIEKTISKTKGQPREPQVYTL PPSREEMTKNQVSLTCLVKGFYPSDIAVEWESNGQPENNYKTTPPM LDSDGSFFLYSKLTVDKSRWQQGNVFSCSVMHEALHNHYTQKSLSL SPGK |
| 402 | G1-KRGEGSSNLF<br>Swap CH1 regions in IgG1 with those of IgG2 | ASTKGPSVFPLAPSSRSTSESTAALGCLVKDYFPEPVTVSWNSGAL TSGVHTFPAVLQSSGLYSLSSVVTVPSSNFGTQTYICNVNHKPSNT KVDKRVEPKSCDKTHTCPPCPAPELLGGPSVFLFPPKPKDTLMISR TPEVTCVVVDVSHEDPEVKFNWYVDGVEVHNAKTKPREEQYNSTYR VVSVLTVLHQDWLNGKEYKCKVSNKALPAPIEKTISKAKGQPREPQ VYTLPPSREEMTKNQVSLTCLVKGFYPSDIAVEWESNGQPENNYKT TPPVLDSDGSFFLYSKLTVDKSRWQQGNVFSCSVMHEALHNHYTQK SLSLSPGK |
| 403 | G1-KRGEGS<br>Swap CH1 regions in IgG1 with those of IgG2 | ASTKGPSVFPLAPSSRSTSESTAALGCLVKDYFPEPVTVSWNSGAL TSGVHTFPAVLQSSGLYSLSSVVTVPSSSLGTQTYICNVNHKPSNT KVDKRVEPKSCDKTHTCPPCPAPELLGGPSVFLFPPKPKDTLMISR TPEVTCVVVDVSHEDPEVKFNWYVDGVEVHNAKTKPREEQYNSTYR VVSVLTVLHQDWLNGKEYKCKVSNKALPAPIEKTISKAKGQPREPQ VYTLPPSREEMTKNQVSLTCLVKGFYPSDIAVEWESNGQPENNYKT TPPVLDSDGSFFLYSKLTVDKSRWQQGNVFSCSVMHEALHNHYTQK SLSLSPGK |
| 404 | G1-SNLF<br>Swap CH1 regions in IgG1 with those of IgG2 | ASTKGPSVFPLAPSSKSTSGGTAALGCLVKDYFPEPVTVSWNSGAL TSGVHTFPAVLQSSGLYSLSSVVTVPSSNFGTQTYICNVNHKPSNT KVDKRVEPKSCDKTHTCPPCPAPELLGGPSVFLFPPKPKDTLMISR TPEVTCVVVDVSHEDPEVKFNWYVDGVEVHNAKTKPREEQYNSTYR VVSVLTVLHQDWLNGKEYKCKVSNKALPAPIEKTISKAKGQPREPQ VYTLPPSREEMTKNQVSLTCLVKGFYPSDIAVEWESNGQPENNYKT TPPVLDSDGSFFLYSKLTVDKSRWQQGNVFSCSVMHEALHNHYTQK SLSLSPGK |
| 405 | IgG1-ITNDRTPR<br>Swap CH1 regions in IgG1 with those of IgG2 | ASTKGPSVFPLAPSSKSTSGGTAALGCLVKDYFPEPVTVSWNSGAL TSGVHTFPAVLQSSGLYSLSSVVTVPSSSLGTQTYTCNVDHKPSNT KVDKTVERKSCDKTHTCPPCPAPELLGGPSVFLFPPKPKDTLMISR TPEVTCVVVDVSHEDPEVKFNWYVDGVEVHNAKTKPREEQYNSTYR VVSVLTVLHQDWLNGKEYKCKVSNKALPAPIEKTISKAKGQPREPQ VYTLPPSREEMTKNQVSLTCLVKGFYPSDIAVEWESNGQPENNYKT TPPVLDSDGSFFLYSKLTVDKSRWQQGNVFSCSVMHEALHNHYTQK SLSLSPGK |
| 406 | G1-SNLFPR<br>Swap CH1 regions in IgG1 with those of IgG2 | ASTKGPSVFPLAPSSKSTSGGTAALGCLVKDYFPEPVTVSWNSGAL TSGVHTFPAVLQSSGLYSLSSVVTVPSSNFGTQTYICNVNHKPSNT KVDKRVERKSCDKTHTCPPCPAPELLGGPSVFLFPPKPKDTLMISR TPEVTCVVVDVSHEDPEVKFNWYVDGVEVHNAKTKPREEQYNSTYR VVSVLTVLHQDWLNGKEYKCKVSNKALPAPIEKTISKAKGQPREPQ VYTLPPSREEMTKNQVSLTCLVKGFYPSDIAVEWESNGQPENNYKT TPPVLDSDGSFFLYSKLTVDKSRWQQGNVFSCSVMHEALHNHYTQK SLSLSPG |

TABLE 15-continued

SUMMARY OF SEQUENCE LISTING

| SEQ ID | Description | Sequence |
|---|---|---|
| 407 | G2-RKEGSGNSFL Swap CH1 regions in IgG2 with those of IgG1 | ASTKGPSVFPLAPCSKSTSGGTAALGCLVKDYFPEPVTVSWNSGAL TSGVHTFPAVLQSSGLYSLSSVVTVPSSSLGTQTYTCNVDHKPSNT KVDKTVERKSCVECPPCPAPPVAGPSVFLFPPKPKDTLMISRTPEV TCVVVDVSHEDPEVQFNWYVDGVEVHNAKTKPREEQFNSTFRVVSV LTVVHQDWLNGKEYKCKVSNKGLPAPIEKTISKTKGQREPQVYTL PPSREEMTKNQVSLTCLVKGFYPSDIAVEWESNGQPENNYKTTPPM LDSDGSFFLYSKLTVDKSRWQQGNVFSCSVMHEALHNHYTQKSLSL SPGK |
| 408 | G2-RKEGSG Swap CH1 regions in IgG2 with those of IgG1 | ASTKGPSVFPLAPCSKSTSGGTAALGCLVKDYFPEPVTVSWNSGAL TSGVHTFPAVLQSSGLYSLSSVVTVPSSNFGTQTYTCNVDHKPSNT KVDKTVERKSCVECPPCPAPPVAGPSVFLFPPKPKDTLMISRTPEV TCVVVDVSHEDPEVQFNWYVDGVEVHNAKTKPREEQFNSTFRVVSV LTVVHQDWLNGKEYKCKVSNKGLPAPIEKTISKTKGQREPQVYTL PPSREEMTKNQVSLTCLVKGFYPSDIAVEWESNGQPENNYKTTPPM LDSDGSFFLYSKLTVDKSRWQQGNVFSCSVMHEALHNHYTQKSLSL SPGK |
| 409 | G2-NSFL Swap CH1 regions in IgG2 with those of IgG1 | ASTKGPSVFPLAPCSRSTSESTAALGCLVKDYFPEPVTVSWN SGALTSGVHTFPAVLQSSGLYSLSSVVTVPSSSLGTQTYTCN VDHKPSNTKVDKTVERKSCVECPPCPAPPVAGPSVFLFPPKP KDTLMISRTPEVTCVVVDVSHEDPEVQFNWYVDGVEVHNAKT KPREEQFNSTFRVVSVLTVVHQDWLNGKEYKCKVSNKGLPAP IEKTISKTKGQREPQVYTLPPSREEMTKNQVSLTCLVKGFY PSDIAVEWESNGQPENNYKTTPPMLDSDGSFFLYSKLTVDKS RWQQGNVFSCSVMHEALHNHYTQKSLSLSPGK |
| 410 | IgG2-TIDNTRRP Swap CH1 regions in IgG2 with those of IgG1 | ASTKGPSVFPLAPCSRSTSESTAALGCLVKDYFPEPVTVSWN SGALTSGVHTFPAVLQSSGLYSLSSVVTVPSSNFGTQTYICN VNHKPSNTKVDKRVEPKSCVECPPCPAPPVAGPSVFLFPPKP KDTLMISRTPEVTCVVVDVSHEDPEVQFNWYVDGVEVHNAKT KPREEQFNSTFRVVSVLTVVHQDWLNGKEYKCKVSNKGLPAP IEKTISKTKGQREPQVYTLPPSREEMTKNQVSLTCLVKGFY PSDIAVEWESNGQPENNYKTTPPMLDSDGSFFLYSKLTVDKS RWQQGNVFSCSVMHEALHNHYTQKSLSLSPGK |
| 411 | G2-NSFLRP Swap CH1 regions in IgG2 with those of IgG1 | ASTKGPSVFPLAPCSRSTSESTAALGCLVKDYFPEPVTVSWNSGAL TSGVHTFPAVLQSSGLYSLSSVVTVPSSSLGTQTYTCNVDHKPSNT KVDKTVEPKSCVECPPCPAPPVAGPSVFLFPPKPKDTLMISRTPEV TCVVVDVSHEDPEVQFNWYVDGVEVHNAKTKPREEQFNSTFRVVSV LTVVHQDWLNGKEYKCKVSNKGLPAPIEKTISKTKGQREPQVYTL PPSREEMTKNQVSLTCLVKGFYPSDIAVEWESNGQPENNYKTTPPM LDSDGSFFLYSKLTVDKSRWQQGNVFSCSVMHEALHNHYTQKSLSL SPGK |
| 412 | G1-G1-G2-G1-AY IgG1 with CH2 domain residues of IgG2 | ASTKGPSVFPLAPSSKSTSGGTAALGCLVKDYFPEPVTVSWNSGAL TSGVHTFPAVLQSSGLYSLSSVVTVPSSSLGTQTYICNVNHKPSNT KVDKRVEPKSCDKTHTCPPCPAPELLGGPSVFLFPPKPKDTLMISR TPEVTCVVVDVSHEDPEVQFNWYVDGVEVHNAKTKPREEQFNSTFR VVSVLTVVHQDWLNGKEYKCKVSNKGLPAPIEKTISKTKGQREPQ VYTLPPSREEMTKNQVSLTCLVKGFYPSDIAVEWESNGQPENNYKT TPPVLDSDGSFFLYSKLTVDKSRWQQGNVFSCSVMHEALHNHYTQK SLSLSPGK |
| 413 | G1-G1-G2-G1-KH IgG1 with CH2 domain residues of IgG2 | ASTKGPSVFPLAPSSKSTSGGTAALGCLVKDYFPEPVTVSWNSGAL TSGVHTFPAVLQSSGLYSLSSVVTVPSSSLGTQTYICNVNHKPSNT KVDKRVEPKSCDKTHTCPPCPAPPVAGPSVFLFPPKPKDTLMISRT PEVTCVVVDVSHEDPEVQFNWYVDGVEVHNAKTKPREEQFNSTFRV VSVLTVVHQDWLNGKEYKCKVSNKGLPAPIEKTISKTKGQREPQV YTLPPSREEMTKNQVSLTCLVKGFYPSDIAVEWESNGQPENNYKTT PPVLDSDGSFFLYSKLTVDKSRWQQGNVFSCSVMHEALHNHYTQKS LSLSPGK |
| 414 | G2-G2.3-G1-G2-KH IgG2 with CH2 domain residues of IgG1 | ASTKGPSVFPLAPCSRSTSESTAALGCLVKDYFPEPVTVSWNSGAL TSGVHTFPAVLQSSGLYSLSSVVTVPSSNFGTQTYTCNVDHKPSNT KVDKTVERKSCVECPPCPAPPVAGPSVFLFPPKPKDTLMISRTPEV TCVVVDVSHEDPEVKFNWYVDGVEVHNAKTKPREEQYNSTYRVVSV LTVLHQDWLNGKEYKCKVSNKALPAPIEKTISKAKGQREPQVYTL PPSREEMTKNQVSLTCLVKGFYPSDIAVEWESNGQPENNYKTTPPM LDSDGSFFLYSKLTVDKSRWQQGNVFSCSVMHEALHNHYTQKSLSL SPGK |

TABLE 15-continued

SUMMARY OF SEQUENCE LISTING

| SEQ ID | Description | Sequence |
|---|---|---|
| 415 | G2.5-G2.3-G1-G2-KH IgG2 with CH2 domain residues of IgG1 | ASTKGPSVFPLAPSSRSTSESTAALGCLVKDYFPEPVTVSWNSGAL TSGVHTFPAVLQSSGLYSLSSVVTVPSSNFGTQTYTCNVDHKPSNT KVDKTVERKSCVECPPCPAPPVAGPSVFLFPPKPKDTLMISRTPEV TCVVVDVSHEDPEVKFNWYVDGVEVHNAKTKPREEQYNSTYRVVSV LTVLHQDWLNGKEYKCKVSNKALPAPIEKTISKAKGQPREPQVYTL PPSREEMTKNQVSLTCLVKGFYPSDIAVEWESNGQPENNYKTTPPM LDSDGSFFLYSKLTVDKSRWQQGNVFSCSVMHEALHNHYTQKSLSL SPGK |
| 416 | G2-G2.3-G1-G2-AY IgG2 with CH2 domain residues of IgG1 | ASTKGPSVFPLAPCSRSTSESTAALGCLVKDYFPEPVTVSWNSGAL TSGVHTFPAVLQSSGLYSLSSVVTVPSSNFGTQTYTCNVDHKPSNT KVDKTVERKSCVECPPCPAPELLGGPSVFLFPPKPKDTLMISRTPE VTCVVVDVSHEDPEVKFNWYVDGVEVHNAKTKPREEQYNSTYRVVS VLTVLHQDWLNGKEYKCKVSNKALPAPIEKTISKAKGQPREPQVYT LPPSREEMTKNQVSLTCLVKGFYPSDIAVEWESNGQPENNYKTTPP MLDSDGSFFLYSKLTVDKSRWQQGNVFSCSVMHEALHNHYTQKSLS LSPG |
| 417 | G2.5-G2.3-G1-G2-AY IgG2 with CH2 domain residues of IgG1 | ASTKGPSVFPLAPSSRSTSESTAALGCLVKDYFPEPVTVSWNSGAL TSGVHTFPAVLQSSGLYSLSSVVTVPSSNFGTQTYTCNVDHKPSNT KVDKTVERKSCVECPPCPAPELLGGPSVFLFPPKPKDTLMISRTPE VTCVVVDVSHEDPEVKFNWYVDGVEVHNAKTKPREEQYNSTYRVVS VLTVLHQDWLNGKEYKCKVSNKALPAPIEKTISKAKGQPREPQVYT LPPSREEMTKNQVSLTCLVKGFYPSDIAVEWESNGQPENNYKTTPP MLDSDGSFFLYSKLTVDKSRWQQGNVFSCSVMHEALHNHYTQKSLS LSPGK |
| 418 | G1-G2.3-G1-G1-KH Swap hinge regions between IgG1 and IgG2 | ASTKGPSVFPLAPSSKSTSGGTAALGCLVKDYFPEPVTVSWNSGAL TSGVHTFPAVLQSSGLYSLSSVVTVPSSSLGTQTYICNVNHKPSNT KVDKRVEPKSCVECPPCPAPPVAGPSVFLFPPKPKDTLMISRTPEV TCVVVDVSHEDPEVKFNWYVDGVEVHNAKTKPREEQYNSTYRVVSV LTVLHQDWLNGKEYKCKVSNKALPAPIEKTISKAKGQPREPQVYTL PPSREEMTKNQVSLTCLVKGFYPSDIAVEWESNGQPENNYKTTPPV LDSDGSFFLYSKLTVDKSRWQQGNVFSCSVMHEALHNHYTQKSLSL SPGK |
| 419 | G2-G1-G2-G2-AY Swap hinge regions between IgG1 and IgG2 | ASTKGPSVFPLAPCSRSTSESTAALGCLVKDYFPEPVTVSWNSGAL TSGVHTFPAVLQSSGLYSLSSVVTVPSSNFGTQTYTCNVDHKPSNT KVDKTVERKSCDKTHTCPPCPAPELLGGPSVFLFPPKPKDTLMISR TPEVTCVVVDVSHEDPEVQFNWYVDGVEVHNAKTKPREEQFNSTFR VVSVLTVVHQDWLNGKEYKCKVSNKGLPAPIEKTISKTKGQPREPQ VYTLPPSREEMTKNQVSLTCLVKGFYPSDIAVEWESNGQPENNYKT TPPMLDSDGSFFLYSKLTVDKSRWQQGNVFSCSVMHEALHNHYTQK SLSLSPGK |
| 420 | G2.5-G1-G2-G2-AY Swap hinge regions between IgG1 and IgG2 | ASTKGPSVFPLAPSSRSTSESTAALGCLVKDYFPEPVTVSWNSGAL TSGVHTFPAVLQSSGLYSLSSVVTVPSSNFGTQTYTCNVDHKPSNT KVDKTVERKSCDKTHTCPPCPAPELLGGPSVFLFPPKPKDTLMISR TPEVTCVVVDVSHEDPEVQFNWYVDGVEVHNAKTKPREEQFNSTFR VVSVLTVVHQDWLNGKEYKCKVSNKGLPAPIEKTISKTKGQPREPQ VYTLPPSREEMTKNQVSLTCLVKGFYPSDIAVEWESNGQPENNYKT TPPMLDSDGSFFLYSKLTVDKSRWQQGNVFSCSVMHEALHNHYTQK SLSLSPGK |
| 421 | G1-G2-G1-G1-AY Swap hinge regions between IgG1 and IgG2 | ASTKGPSVFPLAPSSKSTSGGTAALGCLVKDYFPEPVTVSWNSGAL TSGVHTFPAVLQSSGLYSLSSVVTVPSSSLGTQTYICNVNHKPSNT KVDKRVEPKSCVECPPCPAPELLGGPSVFLFPPKPKDTLMISRTPE VTCVVVDVSHEDPEVKFNWYVDGVEVHNAKTKPREEQYNSTYRVVS VLTVLHQDWLNGKEYKCKVSNKALPAPIEKTISKAKGQPREPQVYT LPPSREEMTKNQVSLTCLVKGFYPSDIAVEWESNGQPENNYKTTPP VLDSDGSFFLYSKLTVDKSRWQQGNVFSCSVMHEALHNHYTQKSLS LSPGK |
| 422 | G2-G1-G2-G2-KH Swap hinge regions between IgG1 and IgG2 | ASTKGPSVFPLAPCSRSTSESTAALGCLVKDYFPEPVTVSWNSGAL TSGVHTFPAVLQSSGLYSLSSVVTVPSSNFGTQTYTCNVDHKPSNT KVDKTVERKSCDKTHTCPPCPAPPVAGPSVFLFPPKPKDTLMISRT PEVTCVVVDVSHEDPEVQFNWYVDGVEVHNAKTKPREEQFNSTFRV VSVLTVVHQDWLNGKEYKCKVSNKGLPAPIEKTISKTKGQPREPQV YTLPPSREEMTKNQVSLTCLVKGFYPSDIAVEWESNGQPENNYKTT PPMLDSDGSFFLYSKLTVDKSRWQQGNVFSCSVMHEALHNHYTQKS LSLSPG |
| 423 | G2.5-G1-G2-G2-KH Swap hinge regions between IgG1 and IgG2 | ASTKGPSVFPLAPSSRSTSESTAALGCLVKDYFPEPVTVSWNSGAL TSGVHTFPAVLQSSGLYSLSSVVTVPSSNFGTQTYTCNVDHKPSNT KVDKTVERKSCDKTHTCPPCPAPPVAGPSVFLFPPKPKDTLMISRT |

TABLE 15-continued

SUMMARY OF SEQUENCE LISTING

| SEQ ID | Description | Sequence |
|---|---|---|
| | | PEVTCVVVDVSHEDPEVQFNWYVDGVEVHNAKTKPREEQFNSTFRV VSVLTVVHQDWLNGKEYKCKVSNKGLPAPIEKTISKTKGQPREPQV YTLPPSREEMTKNQVSLTCLVKGFYPSDIAVEWESNGQPENNYKTT PPMLDSDGSFFLYSKLTVDKSRWQQGNVFSCSVMHEALHNHYTQKS LSLSPGK |
| 424 | IgG1-deltaHinge Hinge truncation | ASTKGPSVFPLAPSSKSTSGGTAALGCLVKDYFPEPVTVSWNSGAL TSGVHTFPAVLQSSGLYSLSSVVTVPSSSLGTQTYICNVNHKPSNT KVDKRVEPKCPPCPAPELLGGPSVFLFPPKPKDTLMISRTPEVTCV VVDVSHEDPEVKFNWYVDGVEVHNAKTKPREEQYNSTYRVVSVLTV LHQDWLNGKEYKCKVSNKALPAPIEKTISKAKGQPREPQVYTLPPS REEMTKNQVSLTCLVKGFYPSDIAVEWESNGQPENNYKTTPPVLDS DGSFFLYSKLTVDKSRWQQGNVFSCSVMHEALHNHYTQKSLSLSPG K |
| 425 | IgG2-deltaHinge Hinge truncation | ASTKGPSVFPLAPCSRSTSESTAALGCLVKDYFPEPVTVSWNSGAL TSGVHTFPAVLQSSGLYSLSSVVTVPSSNFGTQTYTCNVDHKPSNT KVDKTVERKCPPCPAPPVAGPSVFLFPPKPKDTLMISRTPEVTCVV VDVSHEDPEVQFNWYVDGVEVHNAKTKPREEQFNSTFRVVSVLTVV HQDWLNGKEYKCKVSNKGLPAPIEKTISKTKGQPREPQVYTLPPSR EEMTKNQVSLTCLVKGFYPSDIAVEWESNGQPENNYKTTPPMLDSD GSFFLYSKLTVDKSRWQQGNVFSCSVMHEALHNHYTQKSLSLSPGK |
| 426 | IgG2.5-deltaHinge Hinge truncation | ASTKGPSVFPLAPSSRSTSESTAALGCLVKDYFPEPVTVSWNSGAL TSGVHTFPAVLQSSGLYSLSSVVTVPSSNFGTQTYTCNVDHKPSNT KVDKTVERKCPPCPAPPVAGPSVFLFPPKPKDTLMISRTPEVTCVV VDVSHEDPEVQFNWYVDGVEVHNAKTKPREEQFNSTFRVVSVLTVV HQDWLNGKEYKCKVSNKGLPAPIEKTISKTKGQPREPQVYTLPPSR EEMTKNQVSLTCLVKGFYPSDIAVEWESNGQPENNYKTTPPMLDSD GSFFLYSKLTVDKSRWQQGNVFSCSVMHEALHNHYTQKSLSLSPGK |
| 427 | IgG1-deltaG237 Hinge truncation | ASTKGPSVFPLAPSSKSTSGGTAALGCLVKDYFPEPVTVSWNSGAL TSGVHTFPAVLQSSGLYSLSSVVTVPSSSLGTQTYICNVNHKPSNT KVDKRVEPKSCDKTHTCPPCPAPELLGPSVFLFPPKPKDTLMISRT PEVTCVVVDVSHEDPEVKFNWYVDGVEVHNAKTKPREEQYNSTYRV VSVLTVLHQDWLNGKEYKCKVSNKALPAPIEKTISKAKGQPREPQV YTLPPSREEMTKNQVSLTCLVKGFYPSDIAVEWESNGQPENNYKTT PPVLDSDGSFFLYSKLTVDKSRWQQGNVFSCSVMHEALHNHYTQKS LSLSPG |
| 428 | IgG2-plus G237 Hinge truncation | ASTKGPSVFPLAPCSRSTSESTAALGCLVKDYFPEPVTVSWNSGAL TSGVHTFPAVLQSSGLYSLSSVVTVPSSNFGTQTYTCNVDHKPSNT KVDKTVERKSCVECPPCPAPPVAGGPSVFLFPPKPKDTLMISRTPE VTCVVVDVSHEDPEVQFNWYVDGVEVHNAKTKPREEQFNSTFRVVS VLTVVHQDWLNGKEYKCKVSNKGLPAPIEKTISKTKGQPREPQVYT LPPSREEMTKNQVSLTCLVKGFYPSDIAVEWESNGQPENNYKTTPP MLDSDGSFFLYSKLTVDKSRWQQGNVFSCSVMHEALHNHYTQKSLS LSPGK |
| 429 | IgG2.4 | ASTKGPSVFPLAPCSRSTSESTAALGCLVKDYFPEPVTVSWNSGAL TSGVHTFPAVLQSSGLYSLSSVVTVPSSNFGTQTYTCNVDHKPSNT KVDKTVERKCSVECPPCPAPPVAGPSVFLFPPKPKDTLMISRTPEV TCVVVDVSHEDPEVQFNWYVDGVEVHNAKTKPREEQFNSTFRVVSV LTVVHQDWLNGKEYKCKVSNKGLPAPIEKTISKTKGQPREPQVYTL PPSREEMTKNQVSLTCLVKGFYPSDIAVEWESNGQPENNYKTTPPM LDSDGSFFLYSKLTVDKSRWQQGNVFSCSVMHEALHNHYTQKSLSL SPGK |
| 430 | IgG2.3/4 | ASTKGPSVFPLAPCSRSTSESTAALGCLVKDYFPEPVTVSWN SGALTSGVHTFPAVLQSSGLYSLSSVVTVPSSNFGTQTYTCN VDHKPSNTKVDKTVERKSSVECPPCPAPPVAGPSVFLFPPKP KDTLMISRTPEVTCVVVDVSHEDPEVQFNWYVDGVEVHNAKT KPREEQFNSTFRVVSVLTVVHQDWLNGKEYKCKVSNKGLPAP IEKTISKTKGQPREPQVYTLPPSREEMTKNQVSLTCLVKGFY PSDIAVEWESNGQPENNYKTTPPMLDSDGSFFLYSKLTVDKS RWQQGNVFSCSVMHEALHNHYTQKSLSLSPGK |
| 431 | IgG2.3-V13 | ASTKGPSVFPLAPCSRSTSESTAALGCLVKDYFPEPVTVSWNSGAL TSGVHTFPAVLQSSGLYSLSSVVTVPSSNFGTQTYTCNVDHKPSNT KVDKTVERKSCVECPPCPAPPVAGDSVFLFPPKPKDTLMISRTPEV TCVVVDVSHEDPEVQFNWYVDGVEVHNAKTKPREEQFNSTFRVVSV LTVVHQDWLNGKEYKCKVSNKGLPAPIEKTISKTKGQPREPQVYTL PPSREEMTKNQVSLTCLVKGFYPSDIAVEWESNGQPENNYKTTPPM LDSDGSFFLYSKLTVDKSRWQQGNVFSCSVMHEALHNHYTQKSLSL SPGK |

TABLE 15-continued

SUMMARY OF SEQUENCE LISTING

| SEQ ID | Description | Sequence |
|---|---|---|
| 432 | IgG2.3-V14 | ASTKGPSVFPLAPCSRSTSESTAALGCLVKDYFPEPVTVSWNSGAL TSGVHTFPAVLQSSGLYSLSSVVTVPSSNFGTQTYTCNVDHKPSNT KVDKTVERKSCVECPPCPAPPVAGDSVFLFPPKPKDTLMISRTPEV TCVVVDVSHEDGEVQFNWYVDGVEVHNAKTKPREEQFNSTFRVVSV LTVVHQDWLNGKEYKCKVSNKGLPAPIEKTISKTKGQPREPQVYTL PPSREEMTKNQVSLTCLVKGFYPSDIAVEWESNGQPENNYKTTPPM LDSDGSFFLYSKLTVDKSRWQQGNVFSCSVMHEALHNHYTQKSLSL SPGK |
| 433 | IgG2.3-V15 | ASTKGPSVFPLAPCSRSTSESTAALGCLVKDYFPEPVTVSWNSGAL TSGVHTFPAVLQSSGLYSLSSVVTVPSSNFGTQTYTCNVDHKPSNT KVDKTVERKSCVECPPCPAPPVAGDSVFLFPPKPKDTLMISRTPEV TCVVVDVSDEDGEVQFNWYVDGVEVHNAKTKPREEQFNSTFRVVSV LTVVHQDWLNGKEYKCKVSNKGLPAPIEKTISKTKGQPREPQVYTL PPSREEMTKNQVSLTCLVKGFYPSDIAVEWESNGQPENNYKTTPPM LDSDGSFFLYSKLTVDKSRWQQGNVFSCSVMHEALHNHYTQKSLSL SPGK |
| 434 | IgG2.3-V16 | ASTKGPSVFPLAPCSRSTSESTAALGCLVKDYFPEPVTVSWNSGAL TSGVHTFPAVLQSSGLYSLSSVVTVPSSNFGTQTYTCNVDHKPSNT KVDKTVERKSCVECPPCPAPPVAGDSVFLFPPKPKDTLMISRTPEV TCVVVDVSHEDGEVQFNWYVDGVEVHNAKTKPREEQFNSTFRVVSV LTVVHQDWLNGKEYKCKVSNKGLPRPIEKTISKTKGQPREPQVYTL PPSREEMTKNQVSLTCLVKGFYPSDIAVEWESNGQPENNYKTTPPM LDSDGSFFLYSKLTVDKSRWQQGNVFSCSVMHEALHNHYTQKSLSL SPGK |
| 435 | IgG2.3-V17 | ASTKGPSVFPLAPCSRSTSESTAALGCLVKDYFPEPVTVSWNSGAL TSGVHTFPAVLQSSGLYSLSSVVTVPSSNFGTQTYTCNVDHKPSNT KVDKTVERKSCVECPPCPAPPVAGDSVFLFPPKPKDTLMISRTPEV TCVVVDVSDEDGEVQFNWYVDGVEVHNAKTKPREEQFNSTFRVVSV LTVVHQDWLNGKEYKCKVSNKGLPRPIEKTISKTKGQPREPQVYTL PPSREEMTKNQVSLTCLVKGFYPSDIAVEWESNGQPENNYKTTPPM LDSDGSFFLYSKLTVDKSRWQQGNVFSCSVMHEALHNHYTQKSLSL SPGK |
| 436 | IgG2.3-V18 | ASTKGPSVFPLAPCSRSTSESTAALGCLVKDYFPEPVTVSWNSGAL TSGVHTFPAVLQSSGLYSLSSVVTVPSSNFGTQTYTCNVDHKPSNT KVDKTVERKSCVECPPCPAPPVAGPSVFLFPPKPKDTLMISRTPEV TCVVVDVEHEDPEVQFNWYVDGVEVHNAKTKPREEQFNSTFRVVSV LTVVHQDWLNGKEYKCKVSNKGLPAPIEKTISKTKGQPREPQVYTL PPSREEMTKNQVSLTCLVKGFYPSDIAVEWESNGQPENNYKTTPPM LDSDGSFFLYSKLTVDKSRWQQGNVFSCSVMHEALHNHYTQKSLSL SPGK |
| 437 | IgG2.3-V19 | ASTKGPSVFPLAPCSRSTSESTAALGCLVKDYFPEPVTVSWNSGAL TSGVHTFPAVLQSSGLYSLSSVVTVPSSNFGTQTYTCNVDHKPSNT KVDKTVERKSCVECPPCPAPPVAGPSVFLFPPKPKDTLMISRTPEV TCVVVDVEHEDPEVQFNWYVDGVEVHNAKTKPREEQFNSTFRVVSV LTVVHQDWLNGKEYKCKVSNKGFPAPIEKTISKTKGQPREPQVYTL PPSREEMTKNQVSLTCLVKGFYPSDIAVEWESNGQPENNYKTTPPM LDSDGSFFLYSKLTVDKSRWQQGNVFSCSVMHEALHNHYTQKSLSL SPGK |
| 438 | IgG2.3G1-AY-V20 | ASTKGPSVFPLAPCSRSTSESTAALGCLVKDYFPEPVTVSWNSGAL TSGVHTFPAVLQSSGLYSLSSVVTVPSSNFGTQTYTCNVDHKPSNT KVDKTVERKSCVECPPCPAPELLGGDSVFLFPPKPKDTLMISRTPE VTCVVVDVSHEDPEVKFNWYVDGVEVHNAKTKPREEQYNSTYRVVS VLTVLHQDWLNGKEYKCKVSNKALPAPIEKTISKAKGQPREPQVYT LPPSREEMTKNQVSLTCLVKGFYPSDIAVEWESNGQPENNYKTTPP VLDSDGSFFLYSKLTVDKSRWQQGNVFSCSVMHEALHNHYTQKSLS LSPGK |
| 439 | IgG2.3G1-AY-V21 | ASTKGPSVFPLAPCSRSTSESTAALGCLVKDYFPEPVTVSWNSGAL TSGVHTFPAVLQSSGLYSLSSVVTVPSSNFGTQTYTCNVDHKPSNT KVDKTVERKSCVECPPCPAPELLGGDSVFLFPPKPKDTLMISRTPE VTCVVVDVSHEDGEVKFNWYVDGVEVHNAKTKPREEQYNSTYRVVS VLTVLHQDWLNGKEYKCKVSNKALPAPIEKTISKAKGQPREPQVYT LPPSREEMTKNQVSLTCLVKGFYPSDIAVEWESNGQPENNYKTTPP VLDSDGSFFLYSKLTVDKSRWQQGNVFSCSVMHEALHNHYTQKSLS LSPGK |
| 440 | IgG2.3G1-AY-V22 | ASTKGPSVFPLAPCSRSTSESTAALGCLVKDYFPEPVTVSWNSGAL TSGVHTFPAVLQSSGLYSLSSVVTVPSSNFGTQTYTCNVDHKPSNT |

TABLE 15-continued

SUMMARY OF SEQUENCE LISTING

| SEQ ID | Description | Sequence |
|---|---|---|
| | | KVDKTVERKSCVECPPCPAPELLGGDSVFLFPPKPKDTLMISRTPE VTCVVVDVSDEDGEVKFNWYVDGVEVHNAKTKPREEQYNSTYRVVS VLTVLHQDWLNGKEYKCKVSNKALPAPIEKTISKAKGQPREPQVYT LPPSREEMTKNQVSLTCLVKGFYPSDIAVEWESNGQPENNYKTTPP VLDSDGSFFLYSKLTVDKSRWQQGNVFSCSVMHEALHNHYTQKSLS LSPGK |
| 441 | IgG2.3G1-AY-V23 | ASTKGPSVFPLAPCSRSTSESTAALGCLVKDYFPEPVTVSWNSGAL TSGVHTFPAVLQSSGLYSLSSVVTVPSSNFGTQTYTCNVDHKPSNT KVDKTVERKSCVECPPCPAPELLGGDSVFLFPPKPKDTLMISRTPE VTCVVVDVSHEDGEVKFNWYVDGVEVHNAKTKPREEQYNSTYRVVS VLTVLHQDWLNGKEYKCKVSNKALPRPIEKTISKAKGQPREPQVYT LPPSREEMTKNQVSLTCLVKGFYPSDIAVEWESNGQPENNYKTTPP VLDSDGSFFLYSKLTVDKSRWQQGNVFSCSVMHEALHNHYTQKSLS LSPGK |
| 442 | IgG2.3G1-AY-V24 | ASTKGPSVFPLAPCSRSTSESTAALGCLVKDYFPEPVTVSWNSGAL TSGVHTFPAVLQSSGLYSLSSVVTVPSSNFGTQTYTCNVDHKPSNT KVDKTVERKSCVECPPCPAPELLGGDSVFLFPPKPKDTLMISRTPE VTCVVVDVSDEDGEVKFNWYVDGVEVHNAKTKPREEQYNSTYRVVS VLTVLHQDWLNGKEYKCKVSNKALPRPIEKTISKAKGQPREPQVYT LPPSREEMTKNQVSLTCLVKGFYPSDIAVEWESNGQPENNYKTTPP VLDSDGSFFLYSKLTVDKSRWQQGNVFSCSVMHEALHNHYTQKSLS LSPGK |
| 443 | IgG2.3G1-AY-V25 | ASTKGPSVFPLAPCSRSTSESTAALGCLVKDYFPEPVTVSWNSGAL TSGVHTFPAVLQSSGLYSLSSVVTVPSSNFGTQTYTCNVDHKPSNT KVDKTVERKSCVECPPCPAPELLGDDSVFLFPPKPKDTLMISRTPE VTCVVVDVSDEDGEVKFNWYVDGVEVHNAKTKPREEQYNSTYRVVS VLTVLHQDWLNGKEYKCKVSNKALPRPIEKTISKAKGQPREPQVYT LPPSREEMTKNQVSLTCLVKGFYPSDIAVEWESNGQPENNYKTTPP VLDSDGSFFLYSKLTVDKSRWQQGNVFSCSVMHEALHNHYTQKSLS LSPGK |
| 444 | IgG2.3G1-AY-V26 | ASTKGPSVFPLAPCSRSTSESTAALGCLVKDYFPEPVTVSWNSGAL TSGVHTFPAVLQSSGLYSLSSVVTVPSSNFGTQTYTCNVDHKPSNT KVDKTVERKSCVECPPCPAPDLLGDDSVFLFPPKPKDTLMISRTPE VTCVVVDVSDEDGEVKFNWYVDGVEVHNAKTKPREEQYNSTYRVVS VLTVLHQDWLNGKEYKCKVSNKALPRPIEKTISKAKGQPREPQVYT LPPSREEMTKNQVSLTCLVKGFYPSDIAVEWESNGQPENNYKTTPP VLDSDGSFFLYSKLTVDKSRWQQGNVFSCSVMHEALHNHYTQKSLS LSPGK |
| 445 | IgG2.3G1-AY-V27 | ASTKGPSVFPLAPCSRSTSESTAALGCLVKDYFPEPVTVSWNSGAL TSGVHTFPAVLQSSGLYSLSSVVTVPSSNFGTQTYTCNVDHKPSNT KVDKTVERKSCVECPPCPAPELLGGPSVFLFPPKPKDTLMISRTPE VTCVVVDVEHEDPEVKFNWYVDGVEVHNAKTKPREEQYNSTYRVVS VLTVLHQDWLNGKEYKCKVSNKALPAPIEKTISKAKGQPREPQVYT LPPSREEMTKNQVSLTCLVKGFYPSDIAVEWESNGQPENNYKTTPP VLDSDGSFFLYSKLTVDKSRWQQGNVFSCSVMHEALHNHYTQKSLS LSPGK |
| 446 | IgG2.3G1-AY-V28 | ASTKGPSVFPLAPCSRSTSESTAALGCLVKDYFPEPVTVSWNSGAL TSGVHTFPAVLQSSGLYSLSSVVTVPSSNFGTQTYTCNVDHKPSNT KVDKTVERKSCVECPPCPAPELLGGPSVFLFPPKPKDTLMISRTPE VTCVVVDVEHEDPEVKFNWYVDGVEVHNAKTKPREEQYNSTYRVVS VLTVLHQDWLNGKEYKCKVSNKAFPAPIEKTISKAKGQPREPQVYT LPPSREEMTKNQVSLTCLVKGFYPSDIAVEWESNGQPENNYKTTPP VLDSDGSFFLYSKLTVDKSRWQQGNVFSCSVMHEALHNHYTQKSLS LSPGK |
| 447 | Alternative hinge | ERKCCVECPPCPAPPVAG |
| 448 | Alternative hinge | ERKSCVECPPCPAPPVAG |
| 449 | Alternative hinge | ERKCSVECPPCPAPPVAG |
| 450 | Alternative hinge | ERKXCVECPPCPAPPVAG |
| 451 | Alternative hinge | ERKCXVECPPCPAPPVAG |
| 452 | Alternative hinge | ERKCCVECPPCPAPPVAGX |
| 453 | Alternative hinge | ERKSCVECPPCPAPPVAGX |

TABLE 15-continued

SUMMARY OF SEQUENCE LISTING

| SEQ ID | Description | Sequence |
|---|---|---|
| 454 | Alternative hinge | ERKCSVECPPCPAPPVAGX |
| 455 | Alternative hinge | ERKXCVECPPCPAPPVAGX |
| 456 | Alternative hinge | ERKCXVECPPCPAPPVAGX |
| 457 | Alternative hinge | ERKCCVECPPCPAPELLGG |
| 458 | Alternative hinge | ERKSCVECPPCPAPELLGG |
| 459 | Alternative hinge | ERKCCSVECPPCPAPELLGG |
| 460 | Alternative hinge | ERKXCVECPPCPAPELLGG |
| 461 | Alternative hinge | ERKCXVECPPCPAPELLGG |
| 462 | Alternative hinge | ERKCCVECPPCPAPELLG |
| 463 | Alternative hinge | ERKSCVECPPCPAPELLG |
| 464 | Alternative hinge | ERKCCSVECPPCPAPELLG |
| 465 | Alternative hinge | ERKXCVECPPCPAPELLG |
| 466 | Alternative hinge | ERKCXVECPPCPAPELLG |
| 467 | Alternative hinge | ERKCCVECPPCPAP |
| 468 | Alternative hinge | ERKSCVECPPCPAP |
| 469 | Alternative hinge | ERKCSVECPPCPAP |
| 470 | Alternative hinge | ERKXCVECPPCPAP |
| 471 | Alternative hinge | ERKCXVECPPCPAP |
| 472 | Portion of hinge | PVAG |
| 473 | Portion of hinge | ELLG |
| 474 | Portion of hinge | ELLGG |
| 475 | Portion of hinge | SCDKTHT |
| 476 | Portion of hinge | CCVE |
| 477 | wt IgG2 CH1 domain | ASTKGPSVFPLAPCSRSTSESTAALGCLVKDYFPEPVTVSWNSGALTSGVHTFPAVLQSSGLYSLSSVVTVPSS_NF_GTQTYTCNVDHKPSNTKVDKTV |
| 478 | IgG2 CH1 and hinge | ASTKGPSVFPLAPCSRSTSESTAALGCLVKDYFPEPVTVSWNSGALTSGVHTFPAVLQSSGLYSLSSVVTVPSS_NF_GTQTYTCNVDHKPSNTKVDKTVERKCCVECPPCPAPPVAG |
| 479 | Portion of hinge | CPPCPAP |
| 480 | IgG2.3G1-AY-V9-D270E | ASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKSCVECPPCPAPELLGGDDSVFLFPPKPKDTLMISRTPEVTCVVVDVSHEEGEVKFNWYVDGVEVHNAKTKPREEQYNSTYRVVSVLTVLHQDWLNGKEYKCKVSNKALPRPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK |
| 481 | IgG2.3G1-AY-V11 | ASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKSCVECPPCPAPELLGGDDSVFLFPPKPKDTLMISRTPEVTCVVVDVSDEDGEVKFNWYVDGVEVHNAKTKPREEQYNSTYRVVSVLTVLHQDWLNGKEYKCKVSNKALPRPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK |

TABLE 15-continued

SUMMARY OF SEQUENCE LISTING

| SEQ ID | Description | Sequence |
|---|---|---|
| 482 | IgG2.5G1-AY-V9-D270E | ASTKGPSVFPLAPSSRSTSESTAALGCLVKDYFPEPVTVSWNS GALTSGVHTFPAVLQSSGLYSLSSVVTVPSSNFGTQTYTCNV DHKPSNTKVDKTVERKCCVECPPCPAPELLGDDSVFLFPPKP KDTLMISRTPEVTCVVVDVSHEEGEVKFNWYVDGVEVHNA KTKPREEQYNSTYRVVSVLTVLHQDWLNGKEYKCKVSNKA LPRPIEKTISKAKGQPREPQVYTLPPSREEMTKNQVSLTCLVK GFYPSDIAVEWESNGQPENNYKTTPPVLDSDGSFFLYSKLTV DKSRWQQGNVFSCSVMHEALHNHYTQKSLSLSPGK |
| 483 | IgG2.5G1-AY-V11 | ASTKGPSVFPLAPSSRSTSESTAALGCLVKDYFPEPVTVSWNS GALTSGVHTFPAVLQSSGLYSLSSVVTVPSSNFGTQTYTCNV DHKPSNTKVDKTVERKCCVECPPCPAPELLGDDSVFLFPPKP KDTLMISRTPEVTCVVVDVSDEDGEVKFNWYVDGVEVHNA KTKPREEQYNSTYRVVSVLTVLHQDWLNGKEYKCKVSNKA LPRPIEKTISKAKGQPREPQVYTLPPSREEMTKNQVSLTCLVK GFYPSDIAVEWESNGQPENNYKTTPPVLDSDGSFFLYSKLTV DKSRWQQGNVFSCSVMHEALHNHYTQKSLSLSPGK |
| 484 | IgG1f-GASDALIE | ASTKGPSVFPLAPSSKSTSGGTAALGCLVKDYFPEPVTVSWN SGALTSGVHTFPAVLQSSGLYSLSSVVTVPSSSLGTQTYICNV NHKPSNTKVDKRVEPKSCDKTHTCPPCPAPELLAGPDVFLFPP KPKDTLMISRTPEVTCVVVDVSHEDPEVKFNWYVDGVEVHN AKTKPREEQYNSTYRVVSVLTVLHQDWLNGKEYKCKVSNK ALPLPEEKTISKAKGQPREPQVYTLPPSREEMTKNQVSLTCLV KGFYPSDIAVEWESNGQPENNYKTTPPVLDSDGSFFLYSKLT VDKSRWQQGNVFSCSVMHEALHNHYTQKSLSLSPGK |
| 485 | IgG1f-G236A | ASTKGPSVFPLAPSSKSTSGGTAALGCLVKDYFPEPVTVSWN SGALTSGVHTFPAVLQSSGLYSLSSVVTVPSSSLGTQTYICNV NHKPSNTKVDKRVEPKSCDKTHTCPPCPAPELLAGPSVFLFPP KPKDTLMISRTPEVTCVVVDVSHEDPEVKFNWYVDGVEVHN AKTKPREEQYNSTYRVVSVLTVLHQDWLNGKEYKCKVSNK ALPAPIEKTISKAKGQPREPQVYTLPPSREEMTKNQVSLTCLV KGFYPSDIAVEWESNGQPENNYKTTPPVLDSDGSFFLYSKLT VDKSRWQQGNVFSCSVMHEALHNHYTQKSLSLSPGK |
| 486 | IgG2.3G1-AY-G236A | ASTKGPSVFPLAPCSRSTSESTAALGCLVKDYFPEPVTVSWNS GALTSGVHTFPAVLQSSGLYSLSSVVTVPSSNFGTQTYTCNV DHKPSNTKVDKTVERKSCVECPPCPAPELLAGPSVFLFPPKPK DTLMISRTPEVTCVVVDVSHEDPEVKFNWYVDGVEVHNAKT KPREEQYNSTYRVVSVLTVLHQDWLNGKEYKCKVSNKALP APIEKTISKAKGQPREPQVYTLPPSREEMTKNQVSLTCLVKGF YPSDIAVEWESNGQPENNYKTTPPVLDSDGSFFLYSKLTVDK SRWQQGNVFSCSVMHEALHNHYTQKSLSLSPGK |
| 487 | IgG2.3G1-AY-GASDALIE | ASTKGPSVFPLAPCSRSTSESTAALGCLVKDYFPEPVTVSWNS GALTSGVHTFPAVLQSSGLYSLSSVVTVPSSNFGTQTYTCNV DHKPSNTKVDKTVERKSCVECPPCPAPELLAGPDVFLFPPKPK DTLMISRTPEVTCVVVDVSHEDPEVKFNWYVDGVEVHNAKT KPREEQYNSTYRVVSVLTVLHQDWLNGKEYKCKVSNKALPL PEEKTISKAKGQPREPQVYTLPPSREEMTKNQVSLTCLVKGF YPSDIAVEWESNGQPENNYKTTPPVLDSDGSFFLYSKLTVDK SRWQQGNVFSCSVMHEALHNHYTQKSLSLSPGK |
| 488 | IgG2.5G1-AY-G236A | ASTKGPSVFPLAPSSRSTSESTAALGCLVKDYFPEPVTVSWNS GALTSGVHTFPAVLQSSGLYSLSSVVTVPSSNFGTQTYTCNV DHKPSNTKVDKTVERKCCVECPPCPAPELLAGPSVFLFPPKPK DTLMISRTPEVTCVVVDVSHEDPEVKFNWYVDGVEVHNAKT KPREEQYNSTYRVVSVLTVLHQDWLNGKEYKCKVSNKALP APIEKTISKAKGQPREPQVYTLPPSREEMTKNQVSLTCLVKGF YPSDIAVEWESNGQPENNYKTTPPVLDSDGSFFLYSKLTVDK SRWQQGNVFSCSVMHEALHNHYTQKSLSLSPGK |
| 489 | IgG2.5G1-AY-GASDALIE | STKGPSVFPLAPSSRSTSESTAALGCLVKDYFPEPVTVSWNSG ALTSGVHTFPAVLQSSGLYSLSSVVTVPSSNFGTQTYTCNVD HKPSNTKVDKTVERKCCVECPPCPAPELLAGPDVFLFPPKPK DTLMISRTPEVTCVVVDVSHEDPEVKFNWYVDGVEVHNAKT KPREEQYNSTYRVVSVLTVLHQDWLNGKEYKCKVSNKALPL PEEKTISKAKGQPREPQVYTLPPSREEMTKNQVSLTCLVKGF YPSDIAVEWESNGQPENNYKTTPPVLDSDGSFFLYSKLTVDK SRWQQGNVFSCSVMHEALHNHYTQKSLSLSPGK |
| 490 | IgG2.3G1.1f-AY | ASTKGPSVFPLAPCSRSTSESTAALGCLVKDYFPEPVTVSWNS GALTSGVHTFPAVLQSSGLYSLSSVVTVPSSNFGTQTYTCNV DHKPSNTKVDKTVERKSCVECPPCPAPEAEGAPSVFLFPPKPK |

TABLE 15-continued

SUMMARY OF SEQUENCE LISTING

| SEQ ID | Description | Sequence |
|---|---|---|
| | | DTLMISRTPEVTCVVVDVSHEDPEVKFNWYVDGVEVHNAKT KPREEQYNSTYRVVSVLTVLHQDWLNGKEYKCKVSNKALPS SIEKTISKAKGQPREPQVYTLPPSREEMTKNQVSLTCLVKGFY PSDIAVEWESNGQPENNYKTTPPVLDSDGSFFLYSKLTVDKS RWQQGNVFSCSVMHEALHNHYTQKSLSLSPGK |
| 491 | IgG2.3G1.3f-AY | ASTKGPSVFPLAPCSRSTSESTAALGCLVKDYFPEPVTVSWNS GALTSGVHTFPAVLQSSGLYSLSSVVTVPSSNFGTQTYTCNV DHKPSNTKVDKTVERKSCVECPPCPAPEAEGAPSVFLFPPKPK DTLMISRTPEVTCVVVDVSHEDPEVKFNWYVDGVEVHNAKT KPREEQYNSTYRVVSVLTVLHQDWLNGKEYKCKVSNKALP APIEKTISKAKGQPREPQVYTLPPSREEMTKNQVSLTCLVKGF YPSDIAVEWESNGQPENNYKTTPPVLDSDGSFFLYSKLTVDK SRWQQGNVFSCSVMHEALHNHYTQKSLSLSPGK |
| 492 | IgG2.3G1-AY-D265A | ASTKGPSVFPLAPCSRSTSESTAALGCLVKDYFPEPVTVSWNS GALTSGVHTFPAVLQSSGLYSLSSVVTVPSSNFGTQTYTCNV DHKPSNTKVDKTVERKSCVECPPCPAPELLGGPSVFLFPPKPK DTLMISRTPEVTCVVVAVSHEDPEVKFNWYVDGVEVHNAKT KPREEQYNSTYRVVSVLTVLHQDWLNGKEYKCKVSNKALP APIEKTISKAKGQPREPQVYTLPPSREEMTKNQVSLTCLVKGF YPSDIAVEWESNGQPENNYKTTPPVLDSDGSFFLYSKLTVDK SRWQQGNVFSCSVMHEALHNHYTQKSLSLSPGK |
| 493 | IgG2.3G1-AY-N297A | ASTKGPSVFPLAPCSRSTSESTAALGCLVKDYFPEPVTVSWNS GALTSGVHTFPAVLQSSGLYSLSSVVTVPSSNFGTQTYTCNV DHKPSNTKVDKTVERKSCVECPPCPAPELLGGPSVFLFPPKPK DTLMISRTPEVTCVVVDVSHEDPEVKFNWYVDGVEVHNAKT KPREEQYASTYRVVSVLTVLHQDWLNGKEYKCKVSNKALP APIEKTISKAKGQPREPQVYTLPPSREEMTKNQVSLTCLVKGF YPSDIAVEWESNGQPENNYKTTPPVLDSDGSFFLYSKLTVDK SRWQQGNVFSCSVMHEALHNHYTQKSLSLSPGK |
| 494 | IgG2.5G1.1f-AY | ASTKGPSVFPLAPSSRSTSESTAALGCLVKDYFPEPVTVSWNS GALTSGVHTFPAVLQSSGLYSLSSVVTVPSSNFGTQTYTCNV DHKPSNTKVDKTVERKCCVECPPCPAPEAEGAPSVFLFPPKP KDTLMISRTPEVTCVVVDVSHEDPEVKFNWYVDGVEVHNAK TKPREEQYNSTYRVVSVLTVLHQDWLNGKEYKCKVSNKALP SSIEKTISKAKGQPREPQVYTLPPSREEMTKNQVSLTCLVKGF YPSDIAVEWESNGQPENNYKTTPPVLDSDGSFFLYSKLTVDK SRWQQGNVFSCSVMHEALHNHYTQKSLSLSPGK |
| 495 | IgG2.5G1.3f-AY | ASTKGPSVFPLAPSSRSTSESTAALGCLVKDYFPEPVTVSWNS GALTSGVHTFPAVLQSSGLYSLSSVVTVPSSNFGTQTYTCNV DHKPSNTKVDKTVERKCCVECPPCPAPEAEGAPSVFLFPPKP KDTLMISRTPEVTCVVVDVSHEDPEVKFNWYVDGVEVHNAK TKPREEQYNSTYRVVSVLTVLHQDWLNGKEYKCKVSNKALP APIEKTISKAKGQPREPQVYTLPPSREEMTKNQVSLTCLVKGF YPSDIAVEWESNGQPENNYKTTPPVLDSDGSFFLYSKLTVDK SRWQQGNVFSCSVMHEALHNHYTQKSLSLSPGK |
| 496 | IgG2.5G1-AY-D265A | ASTKGPSVFPLAPSSRSTSESTAALGCLVKDYFPEPVTVSWNS GALTSGVHTFPAVLQSSGLYSLSSVVTVPSSNFGTQTYTCNV DHKPSNTKVDKTVERKCCVECPPCPAPELLGGPSVFLFPPKPK DTLMISRTPEVTCVVVAVSHEDPEVKFNWYVDGVEVHNAKT KPREEQYNSTYRVVSVLTVLHQDWLNGKEYKCKVSNKALP APIEKTISKAKGQPREPQVYTLPPSREEMTKNQVSLTCLVKGF YPSDIAVEWESNGQPENNYKTTPPVLDSDGSFFLYSKLTVDK SRWQQGNVFSCSVMHEALHNHYTQKSLSLSPGK |
| 597 | IgG2.5G1-AY-N297A | ASTKGPSVFPLAPSSRSTSESTAALGCLVKDYFPEPVTVSWNS GALTSGVHTFPAVLQSSGLYSLSSVVTVPSSNFGTQTYTCNV DHKPSNTKVDKTVERKCCVECPPCPAPELLGGPSVFLFPPKPK DTLMISRTPEVTCVVVDVSHEDPEVKFNWYVDGVEVHNAKT KPREEQYASTYRVVSVLTVLHQDWLNGKEYKCKVSNKALP APIEKTISKAKGQPREPQVYTLPPSREEMTKNQVSLTCLVKGF YPSDIAVEWESNGQPENNYKTTPPVLDSDGSFFLYSKLTVDK SRWQQGNVFSCSVMHEALHNHYTQKSLSLSPGK |
| 498 | CT | ASTKGPSVFPLAPSSKSTSGGTAALGCLVKDYFPEPVTVSWN SGALTSGVHTFPAVLQSSGLYSLSSVVTVPSSSLGTQTYICNV NHKPSNTKVDKRVEPKSCDKTHTSPPSPAPELLGGSSVFLFPP KPKDTLMISRTPEVTCVVVDVSHEDPEVKFNWYVDGVEVHN AKTKPREEQYNSTYRVVSVLTVLHQDWLNGKEYKCKVSNK ALPAPIEKTISKAKGQPREPQVYTLPPSRDELTKNQVSLTCLV |

TABLE 15-continued

SUMMARY OF SEQUENCE LISTING

| SEQ ID | Description | Sequence |
|---|---|---|
| | | KGFYPSDIAVEWESNGQPENNYKTTPPVLDSDGSFFLYSKLT VDKSRWQQGNVFSCSVMHEALHNHYTQKSLSLSPGK |
| 499 | CTf | ASTKGPSVFPLAPSSKSTSGGTAALGCLVKDYFPEPVTVSWN SGALTSGVHTFPAVLQSSGLYSLSSVVTVPSSSLGTQTYICNV NHKPSNTKVDKRVEPKSCDKTHTSPPSPAPELLGGSSVFLFPP KPKDTLMISRTPEVTCVVVDVSHEDPEVKFNWYVDGVEVHN AKTKPREEQYNSTYRVVSVLTVLHQDWLNGKEYKCKVSNK ALPAPIEKTISKAKGQPREPQVYTLPPSREEMTKNQVSLTCLV KGFYPSDIAVEWESNGQPENNYKTTPPVLDSDGSFFLYSKLT VDKSRWQQGNVFSCSVMHEALHNHYTQKSLSLSPGK |
| 500 | IgG2.3-CT | ASTKGPSVFPLAPCSRSTSESTAALGCLVKDYFPEPVTVSWNS GALTSGVHTFPAVLQSSGLYSLSSVVTVPSSNFGTQTYTCNV DHKPSNTKVDKTVERKSCVESPPSPAPELLGGSSVFLFPPKPK DTLMISRTPEVTCVVVDVSHEDPEVKFNWYVDGVEVHNAKT KPREEQYNSTYRVVSVLTVLHQDWLNGKEYKCKVSNKALP APIEKTISKAKGQPREPQVYTLPPSRDELTKNQVSLTCLVKGF YPSDIAVEWESNGQPENNYKTTPPVLDSDGSFFLYSKLTVDK SRWQQGNVFSCSVMHEALHNHYTQKSLSLSPGK |
| 501 | IgG2.5-CT | ASTKGPSVFPLAPSSRSTSESTAALGCLVKDYFPEPVTVSWNS GALTSGVHTFPAVLQSSGLYSLSSVVTVPSSNFGTQTYTCNV DHKPSNTKVDKTVERKCCVESPPSPAPELLGGSSVFLFPPKPK DTLMISRTPEVTCVVVDVSHEDPEVKFNWYVDGVEVHNAKT KPREEQYNSTYRVVSVLTVLHQDWLNGKEYKCKVSNKALP APIEKTISKAKGQPREPQVYTLPPSRDELTKNQVSLTCLVKGF YPSDIAVEWESNGQPENNYKTTPPVLDSDGSFFLYSKLTVDK SRWQQGNVFSCSVMHEALHNHYTQKSLSLSPGK |
| 502 | IgG1fa-C226S | ASTKGPSVFPLAPSSKSTSGGTAALGCLVKDYFPEPVTVSWN SGALTSGVHTFPAVLQSSGLYSLSSVVTVPSSSLGTQTYICNV NHKPSNTKVDKRVEPKSCDKTHTSPPCPAPELLGGPSVFLFPP KPKDTLMISRTPEVTCVVVDVSHEDPEVKFNWYVDGVEVHN AKTKPREEQYNSTYRVVSVLTVLHQDWLNGKEYKCKVSNK ALPAPIEKTISKAKGQPREPQVYTLPPSRDELTKNQVSLTCLV KGFYPSDIAVEWESNGQPENNYKTTPPVLDSDGSFFLYSKLT VDKSRWQQGNVFSCSVMHEALHNHYTQKSLSLSPGK |
| 503 | IgG1fa-C229S | ASTKGPSVFPLAPSSKSTSGGTAALGCLVKDYFPEPVTVSWN SGALTSGVHTFPAVLQSSGLYSLSSVVTVPSSSLGTQTYICNV NHKPSNTKVDKRVEPKSCDKTHTCPPSPAPELLGGSVFLFPP KPKDTLMISRTPEVTCVVVDVSHEDPEVKFNWYVDGVEVHN AKTKPREEQYNSTYRVVSVLTVLHQDWLNGKEYKCKVSNK ALPAPIEKTISKAKGQPREPQVYTLPPSRDELTKNQVSLTCLV KGFYPSDIAVEWESNGQPENNYKTTPPVLDSDGSFFLYSKLT VDKSRWQQGNVFSCSVMHEALHNHYTQKSLSLSPGK |
| 504 | IgG1fa-C226S,C229S | ASTKGPSVFPLAPSSKSTSGGTAALGCLVKDYFPEPVTVSWN SGALTSGVHTFPAVLQSSGLYSLSSVVTVPSSSLGTQTYICNV NHKPSNTKVDKRVEPKSCDKTHTSPPSPAPELLGGSVFLFPP KPKDTLMISRTPEVTCVVVDVSHEDPEVKFNWYVDGVEVHN AKTKPREEQYNSTYRVVSVLTVLHQDWLNGKEYKCKVSNK ALPAPIEKTISKAKGQPREPQVYTLPPSRDELTKNQVSLTCLV KGFYPSDIAVEWESNGQPENNYKTTPPVLDSDGSFFLYSKLT VDKSRWQQGNVFSCSVMHEALHNHYTQKSLSLSPGK |
| 505 | IgG1fa-P238S | ASTKGPSVFPLAPSSKSTSGGTAALGCLVKDYFPEPVTVSWN SGALTSGVHTFPAVLQSSGLYSLSSVVTVPSSSLGTQTYICNV NHKPSNTKVDKRVEPKSCDKTHTCPPCPAPELLGGSVFLFPP KPKDTLMISRTPEVTCVVVDVSHEDPEVKFNWYVDGVEVHN AKTKPREEQYNSTYRVVSVLTVLHQDWLNGKEYKCKVSNK ALPAPIEKTISKAKGQPREPQVYTLPPSRDELTKNQVSLTCLV KGFYPSDIAVEWESNGQPENNYKTTPPVLDSDGSFFLYSKLT VDKSRWQQGNVFSCSVMHEALHNHYTQKSLSLSPGK |
| 506 | IgG1fa-C226A | ASTKGPSVFPLAPSSKSTSGGTAALGCLVKDYFPEPVTVSWN SGALTSGVHTFPAVLQSSGLYSLSSVVTVPSSSLGTQTYICNV NHKPSNTKVDKRVEPKSCDKTHTAPPCPAPELLGGPSVFLFPP KPKDTLMISRTPEVTCVVVDVSHEDPEVKFNWYVDGVEVHN AKTKPREEQYNSTYRVVSVLTVLHQDWLNGKEYKCKVSNK ALPAPIEKTISKAKGQPREPQVYTLPPSRDELTKNQVSLTCLV KGFYPSDIAVEWESNGQPENNYKTTPPVLDSDGSFFLYSKLT VDKSRWQQGNVFSCSVMHEALHNHYTQKSLSLSPGK |

TABLE 15-continued

SUMMARY OF SEQUENCE LISTING

| SEQ ID | Description | Sequence |
|---|---|---|
| 507 | IgG1fa-C229A | ASTKGPSVFPLAPSSKSTSGGTAALGCLVKDYFPEPVTVSWN SGALTSGVHTFPAVLQSSGLYSLSSVVTVPSSSLGTQTYICNV NHKPSNTKVDKRVEPKSCDKTHTCPPAPAPELLGGPSVFLFPP KPKDTLMISRTPEVTCVVVDVSHEDPEVKFNWYVDGVEVHN AKTKPREEQYNSTYRVVSVLTVLHQDWLNGKEYKCKVSNK ALPAPIEKTISKAKGQPREPQVYTLPPSRDELTKNQVSLTCLV KGFYPSDIAVEWESNGQPENNYKTTPPVLDSDGSFFLYSKLT VDKSRWQQGNVFSCSVMHEALHNHYTQKSLSLSPGK |
| 508 | IgG1fa-C226A,C229A | ASTKGPSVFPLAPSSKSTSGGTAALGCLVKDYFPEPVTVSWN SGALTSGVHTFPAVLQSSGLYSLSSVVTVPSSSLGTQTYICNV NHKPSNTKVDKRVEPKSCDKTHTAPPAPAPELLGGPSVFLFPP KPKDTLMISRTPEVTCVVVDVSHEDPEVKFNWYVDGVEVHN AKTKPREEQYNSTYRVVSVLTVLHQDWLNGKEYKCKVSNK ALPAPIEKTISKAKGQPREPQVYTLPPSRDELTKNQVSLTCLV KGFYPSDIAVEWESNGQPENNYKTTPPVLDSDGSFFLYSKLT VDKSRWQQGNVFSCSVMHEALHNHYTQKSLSLSPGK |
| 509 | IgG1fa-P238K | ASTKGPSVFPLAPSSKSTSGGTAALGCLVKDYFPEPVTVSWN SGALTSGVHTFPAVLQSSGLYSLSSVVTVPSSSLGTQTYICNV NHKPSNTKVDKRVEPKSCDKTHTCPPCPAPELLGGKSVFLFPP KPKDTLMISRTPEVTCVVVDVSHEDPEVKFNWYVDGVEVHN AKTKPREEQYNSTYRVVSVLTVLHQDWLNGKEYKCKVSNK ALPAPIEKTISKAKGQPREPQVYTLPPSRDELTKNQVSLTCLV KGFYPSDIAVEWESNGQPENNYKTTPPVLDSDGSFFLYSKLT VDKSRWQQGNVFSCSVMHEALHNHYTQKSLSLSPGK |
| 510 | IgG2.3-R133K | ASTKGPSVFPLAPCSKSTSESTAALGCLVKDYFPEPVTVSWNS GALTSGVHTFPAVLQSSGLYSLSSVVTVPSSNFGTQTYTCNV DHKPSNTKVDKTVERKSCVECPPCPAPPVAGPSVFLFPPKPKD TLMISRTPEVTCVVVDVSHEDPEVQFNWYVDGVEVHNAKTK PREEQFNSTFRVVSVLTVVHQDWLNGKEYKCKVSNKGLPAPI EKTISKTKGQPREPQVYTLPPSREEMTKNQVSLTCLVKGFYPS DIAVEWESNGQPENNYKTTPPMLDSDGSFFLYSKLTVDKSR WQQGNVFSCSVMHEALHNHYTQKSLSLSPGK |
| 511 | IgG2.3-E137G | ASTKGPSVFPLAPCSRSTSGSTAALGCLVKDYFPEPVTVSWNS GALTSGVHTFPAVLQSSGLYSLSSVVTVPSSNFGTQTYTCNV DHKPSNTKVDKTVERKSCVECPPCPAPPVAGPSVFLFPPKPKD TLMISRTPEVTCVVVDVSHEDPEVQFNWYVDGVEVHNAKTK PREEQFNSTFRVVSVLTVVHQDWLNGKEYKCKVSNKGLPAPI EKTISKTKGQPREPQVYTLPPSREEMTKNQVSLTCLVKGFYPS DIAVEWESNGQPENNYKTTPPMLDSDGSFFLYSKLTVDKSR WQQGNVFSCSVMHEALHNHYTQKSLSLSPGK |
| 512 | IgG2.3-S138G | ASTKGPSVFPLAPCSRSTSEGTAALGCLVKDYFPEPVTVSWNS GALTSGVHTFPAVLQSSGLYSLSSVVTVPSSNFGTQTYTCNV DHKPSNTKVDKTVERKSCVECPPCPAPPVAGPSVFLFPPKPKD TLMISRTPEVTCVVVDVSHEDPEVQFNWYVDGVEVHNAKTK PREEQFNSTFRVVSVLTVVHQDWLNGKEYKCKVSNKGLPAPI EKTISKTKGQPREPQVYTLPPSREEMTKNQVSLTCLVKGFYPS DIAVEWESNGQPENNYKTTPPMLDSDGSFFLYSKLTVDKSR WQQGNVFSCSVMHEALHNHYTQKSLSLSPGK |
| 513 | IgG2.3-E137G-S138G | ASTKGPSVFPLAPCSRSTSGGTAALGCLVKDYFPEPVTVSWN SGALTSGVHTFPAVLQSSGLYSLSSVVTVPSSNFGTQTYTCNV DHKPSNTKVDKTVERKSCVECPPCPAPPVAGPSVFLFPPKPKD TLMISRTPEVTCVVVDVSHEDPEVQFNWYVDGVEVHNAKTK PREEQFNSTFRVVSVLTVVHQDWLNGKEYKCKVSNKGLPAPI EKTISKTKGQPREPQVYTLPPSREEMTKNQVSLTCLVKGFYPS DIAVEWESNGQPENNYKTTPPMLDSDGSFFLYSKLTVDKSR WQQGNVFSCSVMHEALHNHYTQKSLSLSPGK |
| 514 | IgG2.3-T214R | ASTKGPSVFPLAPCSRSTSESTAALGCLVKDYFPEPVTVSWNS GALTSGVHTFPAVLQSSGLYSLSSVVTVPSSNFGTQTYTCNV DHKPSNTKVDKRVERKSCVECPPCPAPPVAGPSVFLFPPKPK DTLMISRTPEVTCVVVDVSHEDPEVQFNWYVDGVEVHNAKT KPREEQFNSTFRVVSVLTVVHQDWLNGKEYKCKVSNKGLPA PIEKTISKTKGQPREPQVYTLPPSREEMTKNQVSLTCLVKGFY PSDIAVEWESNGQPENNYKTTPPMLDSDGSFFLYSKLTVDKS RWQQGNVFSCSVMHEALHNHYTQKSLSLSPGK |
| 515 | IgG2.3-R217P | ASTKGPSVFPLAPCSRSTSESTAALGCLVKDYFPEPVTVSWNS GALTSGVHTFPAVLQSSGLYSLSSVVTVPSSNFGTQTYTCNV DHKPSNTKVDKTVEPKSCVECPPCPAPPVAGPSVFLFPPKPKD |

TABLE 15-continued

SUMMARY OF SEQUENCE LISTING

| SEQ ID | Description | Sequence |
|---|---|---|
| | | TLMISRTPEVTCVVVDVSHEDPEVQFNWYVDGVEVHNAKTK<br>PREEQFNSTFRVVSVLTVVHQDWLNGKEYKCKVSNKGLPAPI<br>EKTISKTGQPREPQVYTLPPSREEMTKNQVSLTCLVKGFYPS<br>DIAVEWESNGQPENNYKTTPPMLDSDGSFFLYSKLTVDKSR<br>WQQGNVFSCSVMHEALHNHYTQKSLSLSPGK |
| 516 | IgG2.3-R217S | ASTKGPSVFPLAPCSRSTSESTAALGCLVKDYFPEPVTVSWNS<br>GALTSGVHTFPAVLQSSGLYSLSSVVTVPSSNFGTQTYTCNV<br>DHKPSNTKVDKTVESKSCVECPPCPAPPVAGPSVFLFPPKPKD<br>TLMISRTPEVTCVVVDVSHEDPEVQFNWYVDGVEVHNAKTK<br>PREEQFNSTFRVVSVLTVVHQDWLNGKEYKCKVSNKGLPAPI<br>EKTISKTGQPREPQVYTLPPSREEMTKNQVSLTCLVKGFYPS<br>DIAVEWESNGQPENNYKTTPPMLDSDGSFFLYSKLTVDKSR<br>WQQGNVFSCSVMHEALHNHYTQKSLSLSPGK |
| 517 | IgG2.3-V224A | ASTKGPSVFPLAPCSRSTSESTAALGCLVKDYFPEPVTVSWNS<br>GALTSGVHTFPAVLQSSGLYSLSSVVTVPSSNFGTQTYTCNV<br>DHKPSNTKVDKTVERKSCAECPPCPAPPVAGPSVFLFPPKPKD<br>TLMISRTPEVTCVVVDVSHEDPEVQFNWYVDGVEVHNAKTK<br>PREEQFNSTFRVVSVLTVVHQDWLNGKEYKCKVSNKGLPAPI<br>EKTISKTGQPREPQVYTLPPSREEMTKNQVSLTCLVKGFYPS<br>DIAVEWESNGQPENNYKTTPPMLDSDGSFFLYSKLTVDKSR<br>WQQGNVFSCSVMHEALHNHYTQKSLSLSPGK |
| 518 | IgG2.3-E225A | ASTKGPSVFPLAPCSRSTSESTAALGCLVKDYFPEPVTVSWNS<br>GALTSGVHTFPAVLQSSGLYSLSSVVTVPSSNFGTQTYTCNV<br>DHKPSNTKVDKTVERKSCVACPPCPAPPVAGPSVFLFPPKPK<br>DTLMISRTPEVTCVVVDVSHEDPEVQFNWYVDGVEVHNAKT<br>KPREEQFNSTFRVVSVLTVVHQDWLNGKEYKCKVSNKGLPA<br>PIEKTISKTGQPREPQVYTLPPSREEMTKNQVSLTCLVKGFY<br>PSDIAVEWESNGQPENNYKTTPPMLDSDGSFFLYSKLTVDKS<br>RWQQGNVFSCSVMHEALHNHYTQKSLSLSPGK |
| 519 | IgG2.3-R133A | ASTKGPSVFPLAPCSASTSESTAALGCLVKDYFPEPVTVSWNS<br>GALTSGVHTFPAVLQSSGLYSLSSVVTVPSSNFGTQTYTCNV<br>DHKPSNTKVDKTVERKSCVECPPCPAPPVAGPSVFLFPPKPKD<br>TLMISRTPEVTCVVVDVSHEDPEVQFNWYVDGVEVHNAKTK<br>PREEQFNSTFRVVSVLTVVHQDWLNGKEYKCKVSNKGLPAPI<br>EKTISKTGQPREPQVYTLPPSREEMTKNQVSLTCLVKGFYPS<br>DIAVEWESNGQPENNYKTTPPMLDSDGSFFLYSKLTVDKSR<br>WQQGNVFSCSVMHEALHNHYTQKSLSLSPGK |
| 520 | IgG2.3-E137D | ASTKGPSVFPLAPCSRSTSDSTAALGCLVKDYFPEPVTVSWNS<br>GALTSGVHTFPAVLQSSGLYSLSSVVTVPSSNFGTQTYTCNV<br>DHKPSNTKVDKTVERKSCVECPPCPAPPVAGPSVFLFPPKPKD<br>TLMISRTPEVTCVVVDVSHEDPEVQFNWYVDGVEVHNAKTK<br>PREEQFNSTFRVVSVLTVVHQDWLNGKEYKCKVSNKGLPAPI<br>EKTISKTGQPREPQVYTLPPSREEMTKNQVSLTCLVKGFYPS<br>DIAVEWESNGQPENNYKTTPPMLDSDGSFFLYSKLTVDKSR<br>WQQGNVFSCSVMHEALHNHYTQKSLSLSPGK |
| 521 | IgG2.3-E137Q | ASTKGPSVFPLAPCSRSTSQSTAALGCLVKDYFPEPVTVSWNS<br>GALTSGVHTFPAVLQSSGLYSLSSVVTVPSSNFGTQTYTCNV<br>DHKPSNTKVDKTVERKSCVECPPCPAPPVAGPSVFLFPPKPKD<br>TLMISRTPEVTCVVVDVSHEDPEVQFNWYVDGVEVHNAKTK<br>PREEQFNSTFRVVSVLTVVHQDWLNGKEYKCKVSNKGLPAPI<br>EKTISKTGQPREPQVYTLPPSREEMTKNQVSLTCLVKGFYPS<br>DIAVEWESNGQPENNYKTTPPMLDSDGSFFLYSKLTVDKSR<br>WQQGNVFSCSVMHEALHNHYTQKSLSLSPGK |
| 522 | IgG2.3-S138T | ASTKGPSVFPLAPCSRSTSETTAALGCLVKDYFPEPVTVSWNS<br>GALTSGVHTFPAVLQSSGLYSLSSVVTVPSSNFGTQTYTCNV<br>DHKPSNTKVDKTVERKSCVECPPCPAPPVAGPSVFLFPPKPKD<br>TLMISRTPEVTCVVVDVSHEDPEVQFNWYVDGVEVHNAKTK<br>PREEQFNSTFRVVSVLTVVHQDWLNGKEYKCKVSNKGLPAPI<br>EKTISKTGQPREPQVYTLPPSREEMTKNQVSLTCLVKGFYPS<br>DIAVEWESNGQPENNYKTTPPMLDSDGSFFLYSKLTVDKSR<br>WQQGNVFSCSVMHEALHNHYTQKSLSLSPGK |
| 523 | IgG2.3-S138E | ASTKGPSVFPLAPCSRSTSEETAALGCLVKDYFPEPVTVSWNS<br>GALTSGVHTFPAVLQSSGLYSLSSVVTVPSSNFGTQTYTCNV<br>DHKPSNTKVDKTVERKSCVECPPCPAPPVAGPSVFLFPPKPKD<br>TLMISRTPEVTCVVVDVSHEDPEVQFNWYVDGVEVHNAKTK<br>PREEQFNSTFRVVSVLTVVHQDWLNGKEYKCKVSNKGLPAPI<br>EKTISKTGQPREPQVYTLPPSREEMTKNQVSLTCLVKGFYPS |

TABLE 15-continued

SUMMARY OF SEQUENCE LISTING

| SEQ ID | Description | Sequence |
|---|---|---|
| | | DIAVEWESNGQPENNYKTTPPMLDSDGSFFLYSKLTVDKSR WQQGNVFSCSVMHEALHNHYTQKSLSLSPGK |
| 524 | IgG2.3-E137A-S138I | ASTKGPSVFPLAPCSRSTSAITAALGCLVKDYFPEPVTVSWNS GALTSGVHTFPAVLQSSGLYSLSSVVTVPSSNFGTQTYTCNV DHKPSNTKVDKTVERKSCVECPPCPAPPVAGPSVFLFPPKPKD TLMISRTPEVTCVVVDVSHEDPEVQFNWYVDGVEVHNAKTK PREEQFNSTFRVVSVLTVVHQDWLNGKEYKCKVSNKGLPAPI EKTISKTKGQPREPQVYTLPPSREEMTKNQVSLTCLVKGFYPS DIAVEWESNGQPENNYKTTPPMLDSDGSFFLYSKLTVDKSR WQQGNVFSCSVMHEALHNHYTQKSLSLSPGK |
| 525 | IgG2.3-E137I-S138A | ASTKGPSVFPLAPCSRSTSIATAALGCLVKDYFPEPVTVSWNS GALTSGVHTFPAVLQSSGLYSLSSVVTVPSSNFGTQTYTCNV DHKPSNTKVDKTVERKSCVECPPCPAPPVAGPSVFLFPPKPKD TLMISRTPEVTCVVVDVSHEDPEVQFNWYVDGVEVHNAKTK PREEQFNSTFRVVSVLTVVHQDWLNGKEYKCKVSNKGLPAPI EKTISKTKGQPREPQVYTLPPSREEMTKNQVSLTCLVKGFYPS DIAVEWESNGQPENNYKTTPPMLDSDGSFFLYSKLTVDKSR WQQGNVFSCSVMHEALHNHYTQKSLSLSPGK |
| 526 | IgG2.3-R217G | ASTKGPSVFPLAPCSRSTSESTAALGCLVKDYFPEPVTVSWNS GALTSGVHTFPAVLQSSGLYSLSSVVTVPSSNFGTQTYTCNV DHKPSNTKVDKTVEGKSCVECPPCPAPPVAGPSVFLFPPKPK DTLMISRTPEVTCVVVDVSHEDPEVQFNWYVDGVEVHNAKT KPREEQFNSTFRVVSVLTVVHQDWLNGKEYKCKVSNKGLPA PIEKTISKTKGQPREPQVYTLPPSREEMTKNQVSLTCLVKGFY PSDIAVEWESNGQPENNYKTTPPMLDSDGSFFLYSKLTVDKS RWQQGNVFSCSVMHEALHNHYTQKSLSLSPGK |
| 527 | IgG2.3-R217A | ASTKGPSVFPLAPCSRSTSESTAALGCLVKDYFPEPVTVSWNS GALTSGVHTFPAVLQSSGLYSLSSVVTVPSSNFGTQTYTCNV DHKPSNTKVDKTVEAKSCVECPPCPAPPVAGPSVFLFPPKPK DTLMISRTPEVTCVVVDVSHEDPEVQFNWYVDGVEVHNAKT KPREEQFNSTFRVVSVLTVVHQDWLNGKEYKCKVSNKGLPA PIEKTISKTKGQPREPQVYTLPPSREEMTKNQVSLTCLVKGFY PSDIAVEWESNGQPENNYKTTPPMLDSDGSFFLYSKLTVDKS RWQQGNVFSCSVMHEALHNHYTQKSLSLSPGK |
| 528 | IgG2.3-R217I | ASTKGPSVFPLAPCSRSTSESTAALGCLVKDYFPEPVTVSWNS GALTSGVHTFPAVLQSSGLYSLSSVVTVPSSNFGTQTYTCNV DHKPSNTKVDKTVEIKSCVECPPCPAPPVAGPSVFLFPPKPKD TLMISRTPEVTCVVVDVSHEDPEVQFNWYVDGVEVHNAKTK PREEQFNSTFRVVSVLTVVHQDWLNGKEYKCKVSNKGLPAPI EKTISKTKGQPREPQVYTLPPSREEMTKNQVSLTCLVKGFYPS DIAVEWESNGQPENNYKTTPPMLDSDGSFFLYSKLTVDKSR WQQGNVFSCSVMHEALHNHYTQKSLSLSPGK |
| 529 | IgG2.3-R217E | ASTKGPSVFPLAPCSRSTSESTAALGCLVKDYFPEPVTVSWNS GALTSGVHTFPAVLQSSGLYSLSSVVTVPSSNFGTQTYTCNV DHKPSNTKVDKTVEEKSCVECPPCPAPPVAGPSVFLFPPKPKD TLMISRTPEVTCVVVDVSHEDPEVQFNWYVDGVEVHNAKTK PREEQFNSTFRVVSVLTVVHQDWLNGKEYKCKVSNKGLPAPI EKTISKTKGQPREPQVYTLPPSREEMTKNQVSLTCLVKGFYPS DIAVEWESNGQPENNYKTTPPMLDSDGSFFLYSKLTVDKSR WQQGNVFSCSVMHEALHNHYTQKSLSLSPGK |
| 530 | IgG2.3-R217K | ASTKGPSVFPLAPCSRSTSESTAALGCLVKDYFPEPVTVSWNS GALTSGVHTFPAVLQSSGLYSLSSVVTVPSSNFGTQTYTCNV DHKPSNTKVDKTVEKKSCVECPPCPAPPVAGPSVFLFPPKPK DTLMISRTPEVTCVVVDVSHEDPEVQFNWYVDGVEVHNAKT KPREEQFNSTFRVVSVLTVVHQDWLNGKEYKCKVSNKGLPA PIEKTISKTKGQPREPQVYTLPPSREEMTKNQVSLTCLVKGFY PSDIAVEWESNGQPENNYKTTPPMLDSDGSFFLYSKLTVDKS RWQQGNVFSCSVMHEALHNHYTQKSLSLSPGK |
| 531 | IgG2.3-V224I | ASTKGPSVFPLAPCSRSTSESTAALGCLVKDYFPEPVTVSWNS GALTSGVHTFPAVLQSSGLYSLSSVVTVPSSNFGTQTYTCNV DHKPSNTKVDKTVERKSCIECPPCPAPPVAGPSVFLFPPKPKD TLMISRTPEVTCVVVDVSHEDPEVQFNWYVDGVEVHNAKTK PREEQFNSTFRVVSVLTVVHQDWLNGKEYKCKVSNKGLPAPI EKTISKTKGQPREPQVYTLPPSREEMTKNQVSLTCLVKGFYPS DIAVEWESNGQPENNYKTTPPMLDSDGSFFLYSKLTVDKSR WQQGNVFSCSVMHEALHNHYTQKSLSLSPGK |

TABLE 15-continued

SUMMARY OF SEQUENCE LISTING

| SEQ ID | Description | Sequence |
|---|---|---|
| 532 | IgG2.3-E225D | ASTKGPSVFPLAPCSRSTSESTAALGCLVKDYFPEPVTVSWNS<br>GALTSGVHTFPAVLQSSGLYSLSSVVTVPSSNFGTQTYTCNV<br>DHKPSNTKVDKTVERKSCVDCPPCPAPPVAGPSVFLFPPKPK<br>DTLMISRTPEVTCVVVDVSHEDPEVQFNWYVDGVEVHNAKT<br>KPREEQFNSTFRVVSVLTVVHQDWLNGKEYKCKVSNKGLPA<br>PIEKTISKTKGQPREPQVYTLPPSREEMTKNQVSLTCLVKGFY<br>PSDIAVEWESNGQPENNYKTTPPMLDSDGSFFLYSKLTVDKS<br>RWQQGNVFSCSVMHEALHNHYTQKSLSLSPGK |
| 533 | IgG2-G4.1-G4-G4 | ASTKGPSVFPLAPCSRSTSESTAALGCLVKDYFPEPVTVSWNS<br>GALTSGVHTFPAVLQSSGLYSLSSVVTVPSSNFGTQTYTCNV<br>DHKPSNTKVDKTVERKYGPPCPPCPAPEFLGGPSVFLFPPKPK<br>DTLMISRTPEVTCVVVDVSQEDPEVQFNWYVDGVEVHNAKT<br>KPREEQFNSTYRVVSVLTVLHQDWLNGKEYKCKVSNKGLPS<br>SIEKTISKAKGQPREPQVYTLPPSQEEMTKNQVSLTCLVKGFY<br>PSDIAVEWESNGQPENNYKTTPPVLDSDGSFFLYSRLTVDKSR<br>WQEGNVFSCSVMHEALHNHYTQKSLSLSLGK |
| 534 | IgG4-G2.3-G2-G2 | ASTKGPSVFPLAPCSRSTSESTAALGCLVKDYFPEPVTVSWNS<br>GALTSGVHTFPAVLQSSGLYSLSSVVTVPSSSLGTKTYTCNVD<br>HKPSNTKVDKRVESKSCVECPPCPAPPVAGPSVFLFPPKPKDT<br>LMISRTPEVTCVVVDVSHEDPEVQFNWYVDGVEVHNAKTKP<br>REEQFNSTFRVVSVLTVVHQDWLNGKEYKCKVSNKGLPAPI<br>EKTISKTKGQPREPQVYTLPPSREEMTKNQVSLTCLVKGFYPS<br>DIAVEWESNGQPENNYKTTPPMLDSDGSFFLYSKLTVDKSR<br>WQQGNVFSCSVMHEALHNHYTQKSLSLSPGK |
| 535 | IgG2-G4.1-G2-G2 | ASTKGPSVFPLAPCSRSTSESTAALGCLVKDYFPEPVTVSWNS<br>GALTSGVHTFPAVLQSSGLYSLSSVVTVPSSNFGTQTYTCNV<br>DHKPSNTKVDKTVERKYGPPCPPCPAPEFLGGPSVFLFPPKPK<br>DTLMISRTPEVTCVVVDVSHEDPEVQFNWYVDGVEVHNAKT<br>KPREEQFNSTFRVVSVLTVVHQDWLNGKEYKCKVSNKGLPA<br>PIEKTISKTKGQPREPQVYTLPPSREEMTKNQVSLTCLVKGFY<br>PSDIAVEWESNGQPENNYKTTPPMLDSDGSFFLYSKLTVDKS<br>RWQQGNVFSCSVMHEALHNHYTQKSLSLSPGK |
| 536 | IgG4-G2.3-G4-G4 | ASTKGPSVFPLAPCSRSTSESTAALGCLVKDYFPEPVTVSWNS<br>GALTSGVHTFPAVLQSSGLYSLSSVVTVPSSSLGTKTYTCNVD<br>HKPSNTKVDKRVESKSCVECPPCPAPPVAGPSVFLFPPKPKDT<br>LMISRTPEVTCVVVDVSQEDPEVQFNWYVDGVEVHNAKTKP<br>REEQFNSTYRVVSVLTVLHQDWLNGKEYKCKVSNKGLPSSIE<br>KTISKAKGQPREPQVYTLPPSQEEMTKNQVSLTCLVKGFYPS<br>DIAVEWESNGQPENNYKTTPPVLDSDGSFFLYSRLTVDKSRW<br>QEGNVFSCSVMHEALHNHYTQKSLSLSLGK |
| 537 | IgG2-G2.3-G4-G4 | ASTKGPSVFPLAPCSRSTSESTAALGCLVKDYFPEPVTVSWNS<br>GALTSGVHTFPAVLQSSGLYSLSSVVTVPSSNFGTQTYTCNV<br>DHKPSNTKVDKTVERKSCVECPPCPAPPVAGPSVFLFPPKPKD<br>TLMISRTPEVTCVVVDVSQEDPEVQFNWYVDGVEVHNAKTK<br>PREEQFNSTYRVVSVLTVLHQDWLNGKEYKCKVSNKGLPSSI<br>EKTISKAKGQPREPQVYTLPPSQEEMTKNQVSLTCLVKGFYP<br>SDIAVEWESNGQPENNYKTTPPVLDSDGSFFLYSRLTVDKSR<br>WQEGNVFSCSVMHEALHNHYTQKSLSLSLGK |
| 538 | IgG4-G4.1-G2-G2 | ASTKGPSVFPLAPCSRSTSESTAALGCLVKDYFPEPVTVSWNS<br>GALTSGVHTFPAVLQSSGLYSLSSVVTVPSSSLGTKTYTCNVD<br>HKPSNTKVDKRVESKYGPPCPPCPAPEFLGGPSVFLFPPKPKD<br>TLMISRTPEVTCVVVDVSHEDPEVQFNWYVDGVEVHNAKTK<br>PREEQFNSTFRVVSVLTVVHQDWLNGKEYKCKVSNKGLPAPI<br>EKTISKTKGQPREPQVYTLPPSREEMTKNQVSLTCLVKGFYPS<br>DIAVEWESNGQPENNYKTTPPMLDSDGSFFLYSKLTVDKSR<br>WQQGNVFSCSVMHEALHNHYTQKSLSLSPGK |
| 539 | IgG4-G4.1-G1-G1 | ASTKGPSVFPLAPCSRSTSESTAALGCLVKDYFPEPVTVSWNS<br>GALTSGVHTFPAVLQSSGLYSLSSVVTVPSSSLGTKTYTCNVD<br>HKPSNTKVDKRVESKYGPPCPPCPAPEFLGGPSVFLFPPKPKD<br>TLMISRTPEVTCVVVDVSHEDPEVKFNWYVDGVEVHNAKTK |

TABLE 15-continued

SUMMARY OF SEQUENCE LISTING

| SEQ ID | Description | Sequence |
|---|---|---|
| | | PREEQYNSTYRVVSVLTVLHQDWLNGKEYKCKVSNKALPAP<br>IEKTISKAKGQPREPQVYTLPPSREEMTKNQVSLTCLVKGFYP<br>SDIAVEWESNGQPENNYKTTPPVLDSDGSFFLYSKLTVDKSR<br>WQQGNVFSCSVMHEALHNHYTQKSLSLSPGK |
| 540 | IgG4.1 | ASTKGPSVFPLAPCSRSTSESTAALGCLVKDYFPEPVTVSWNS<br>GALTSGVHTFPAVLQSSGLYSLSSVVTVPSSSLGTKTYTCNVD<br>HKPSNTKVDKRVESKYGPPCPPCPAPEFLGGPSVFLFPPKPKD<br>TLMISRTPEVTCVVVDVSQEDPEVQFNWYVDGVEVHNAKTK<br>PREEQFNSTYRVVSVLTVLHQDWLNGKEYKCKVSNKGLPSSI<br>EKTISKAKGQPREPQVYTLPPSQEEMTKNQVSLTCLVKGFYP<br>SDIAVEWESNGQPENNYKTTPPVLDSDGSFFLYSRLTVDKSR<br>WQEGNVFSCSVMHEALHNHYTQKSLSLSLGK |
| 541 | IgG4.1-R214T | ASTKGPSVFPLAPCSRSTSESTAALGCLVKDYFPEPVTVSWNS<br>GALTSGVHTFPAVLQSSGLYSLSSVVTVPSSSLGTKTYTCNVD<br>HKPSNTKVDKTVESKYGPPCPPCPAPEFLGGPSVFLFPPKPKD<br>TLMISRTPEVTCVVVDVSQEDPEVQFNWYVDGVEVHNAKTK<br>PREEQFNSTYRVVSVLTVLHQDWLNGKEYKCKVSNKGLPSSI<br>EKTISKAKGQPREPQVYTLPPSQEEMTKNQVSLTCLVKGFYP<br>SDIAVEWESNGQPENNYKTTPPVLDSDGSFFLYSRLTVDKSR<br>WQEGNVFSCSVMHEALHNHYTQKSLSLSLGK |
| 542 | IgG4.1-S217R | ASTKGPSVFPLAPCSRSTSESTAALGCLVKDYFPEPVTVSWNS<br>GALTSGVHTFPAVLQSSGLYSLSSVVTVPSSSLGTKTYTCNVD<br>HKPSNTKVDKRVERKYGPPCPPCPAPEFLGGPSVFLFPPKPKD<br>TLMISRTPEVTCVVVDVSQEDPEVQFNWYVDGVEVHNAKTK<br>PREEQFNSTYRVVSVLTVLHQDWLNGKEYKCKVSNKGLPSSI<br>EKTISKAKGQPREPQVYTLPPSQEEMTKNQVSLTCLVKGFYP<br>SDIAVEWESNGQPENNYKTTPPVLDSDGSFFLYSRLTVDKSR<br>WQEGNVFSCSVMHEALHNHYTQKSLSLSLGK |
| 543 | IgG4.1-S217P | ASTKGPSVFPLAPCSRSTSESTAALGCLVKDYFPEPVTVSWNS<br>GALTSGVHTFPAVLQSSGLYSLSSVVTVPSSSLGTKTYTCNVD<br>HKPSNTKVDKRVEPKYGPPCPPCPAPEFLGGPSVFLFPPKPKD<br>TLMISRTPEVTCVVVDVSQEDPEVQFNWYVDGVEVHNAKTK<br>PREEQFNSTYRVVSVLTVLHQDWLNGKEYKCKVSNKGLPSSI<br>EKTISKAKGQPREPQVYTLPPSQEEMTKNQVSLTCLVKGFYP<br>SDIAVEWESNGQPENNYKTTPPVLDSDGSFFLYSRLTVDKSR<br>WQEGNVFSCSVMHEALHNHYTQKSLSLSLGK |

Table 15 provides the sequences of the mature variable regions and heavy and light chains and where indicated, sequences with signal peptides. Heavy chains shown with K or GK at their C-terminus may also be used without the K or GK.

EQUIVALENTS

Those skilled in the art will recognize, or be able to ascertain using no more than routine experimentation, many equivalents of the specific embodiments disclosed herein. Such equivalents are intended to be encompassed by the following claims.

SEQUENCE LISTING (543 sequences)

SEQ ID NO: 1 - protein, 241 aa, Homo sapiens
  misc_feature (1)..(241): Human GITR isoform 1
MAQHGAMGAFRALCGLALLCALSLGQRPTGGPGCGPGRLLLGTGTDARCCRVHTTRCCRDYPGEECCSEWDCMCVQPEFHCGDPCCTTCRHHPCPPGQGVQSQGKFSFGFQCIDCASGTFSGGHEGHCKPWTDCTQFGFLTVFPGNKTHNAVCVPGSPPAEPLGWLTVVLLAVAACVLLLTSAQLGLHIWQLRSQCMWPRETQLLLEVPPSTEDARSCQFPEEERGERSAEEKGRLGDLWV

SEQ ID NO: 2 - protein, 255 aa, Homo sapiens
  misc_feature (1)..(255): Human GITR isoform 2
MAQHGAMGAFRALCGLALLCALSLGQRPTGGPGCGPGRLLLGTGTDARCCRVHTTRCCRDYPGEECCSEWDCMCVQPEFHCGDPCCTTCRHHPCPPGQGVQSQGKFSFGFQCIDCASGTFSGGHEGHCKPWTDCCWRCRRRPKTPEAASSPRKSGASDRQRRRGGWETCGCEPGRPPGPPTAASPSPGAPQAAGALRSALGRALLPWQQKWVQEGGSDQRPGPCSSAAAAGPCRRERETQSWPPSSLAGPDGVGS

SEQ ID NO: 3 - protein, 234 aa, Homo sapiens
  misc_feature (1)..(234): Human GITR isoform 3
MAQHGAMGAFRALCGLALLCALSLGQRPTGGPGCGPGRLLLGTGTDARCCRVHTTRCCRDYPGEECCSEWDCMCVQPEFHCGDPCCTTCRHHPCPPGQGVQSQGKFSFGFQCIDCASGTFSGGHEGHCKPWTDCTQFGFLTVFPGNKTHNAVCVPGSPPAEPLGWLTVVLLAVAACVLLLTSAQLGLHIWQLRKTQLLLEVPPSTEDARSCQFPEEERGERSAEEKGRLGDLWV

SEQ ID NO: 4 - protein, 137 aa, Homo sapiens
  misc_feature (1)..(137): Human GITR (mature)
QRPTGGPGCGPGRLLLGTGTDARCCRVHTTRCCRDYPGEECCSEWDCMCVQPEFHCGDPCCTTCRHHPCPPGQGVQSQGKFSFGFQCIDCASGTFSGGHEGHCKPWTDCTQFGFLTVFPGNKTHNAVCVPGSPPAEP

SEQ ID NO: 5 - protein, 235 aa, Macaca fascicularis
  misc_feature (1)..(235): Cynomolgus GITR
MCASGTLCCLALLCAASLGQRPTGGPGCGPGRLLLGTGKDARCCRVHPTRCCRDYQGEECCSEWDCVCVQPEFHCGNPCCTTCQHHPCPSGQGVQPQGKFSFGFRCVDCALGTFSRGHDGHCKPWTDCTQFGFLTVFPGNKTHNAVCVPGSPPAEPPGWLTIILLAVAACVLLLTSAQLGLHIWQLRSQPTGPRETQLLLEVPPSTEDASSCQFPEEERGERLAEEKGRLGDLWV

SEQ ID NO: 6 - protein, 199 aa, Homo sapiens
  misc_feature (1)..(199): Human GITR-L
MTLHPSPITCEFLFSTALISPKMCLSHLENMPLSHSRTQGAQRSSWKLWLFCSIVMLLFLCSFSWLIFIFLQLETAKEPCMAKFGPLPSKWQMASSEPPCVNKVSDWKLEILQNGLYLIYGQVAPNANYNDVAPFEVRLYKNKDMIQTLTNKSKIQNVGGTYELHVGDTIDLIFNSEHQVLKNNTYWGIILLANPQFIS

SEQ ID NO: 7 - protein, 329 aa, Homo sapiens
  misc_feature (1)..(329): Human IgG1 constant domain
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 8 - protein, 329 aa, Homo sapiens
  misc_feature (1)..(329): Human IgG1 constant domain (allotypic variant)
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 9 - protein, 329 aa, Homo sapiens
  misc_feature (1)..(329): Human IgG1constant domain with L234A, L235E, and G237A mutations
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 10 - protein, 329 aa, Homo sapiens
  misc_feature (1)..(329): Human IgG1constant domain with A330S and P331S mutations
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPSSIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 11 - protein, 329 aa, Homo sapiens
  misc_feature (1)..(329): Human IgG1.1 constant domain (L234A, L235E, G237A, A330S, and P331S mutations)
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPSSIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 12 - protein, 107 aa, Homo sapiens [sequence omitted]

SEQ ID NO: 13 - protein, 124 aa, Artificial Sequence
  Synthetic: 28F3 (VH)
QVQLVESGGGVVQPGRSLRLSCAASGFTFSSYGMHWVRQAPGKGLEWVAVIWYEGSNKYYADSVKGRFTISRDNSKNTLYLQMNSLRAEDTAVYYCARGGSMVRGDYYYGMDVWGQGTTVTVSS

SEQ ID NO: 14 - protein, 107 aa, Artificial Sequence
  Synthetic: 28F3 (VL)
AIQLTQSPSSLSASVGDRVTITCRASQGISSALAWYQQKPGKAPKLLIYDASSLESGVPSRFSGSGSGTDFTLTISSLQPEDFATYYCQQFNSYPYTFGQGTKLEIK

SEQ ID NO: 15 - protein, 450 aa, Artificial Sequence
  Synthetic: 28F3 (full length wild-type heavy chain)
QVQLVESGGGVVQPGRSLRLSCAASGFTFSSYGMHWVRQAPGKGLEWVAVIWYEGSNKYYADSVKGRFTISRDNSKNTLYLQMNSLRAEDTAVYYCARGGSMVRGDYYYGMDVWGQGTTVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 16 - protein, 214 aa, Artificial Sequence
  Synthetic: 28F3 (full length wild-type light chain)
AIQLTQSPSSLSASVGDRVTITCRASQGISSALAWYQQKPGKAPKLLIYDASSLESGVPSRFSGSGSGTDFTLTISSLQPEDFATYYCQQFNSYPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 17 - protein, 453 aa, Artificial Sequence
  Synthetic: 28F3.IgG1 (VH + IgG1)
QVQLVESGGGVVQPGRSLRLSCAASGFTFSSYGMHWVRQAPGKGLEWVAVIWYEGSNKYYADSVKGRFTISRDNSKNTLYLQMNSLRAEDTAVYYCARGGSMVRGDYYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 18 - protein, 453 aa, Artificial Sequence
  Synthetic: 28F3.IgG1.1 (VH + IgG1.1)
QVQLVESGGGVVQPGRSLRLSCAASGFTFSSYGMHWVRQAPGKGLEWVAVIWYEGSNKYYADSVKGRFTISRDNSKNTLYLQMNSLRAEDTAVYYCARGGSMVRGDYYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPSSIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 19 - protein, 214 aa, Artificial Sequence; identical to SEQ ID NO: 16
  Synthetic: 28F3.IgG1 (VL + CL)

SEQ ID NO: 20 - protein, 5 aa, Artificial Sequence
  Synthetic: 28F3 VH CDR1
SYGMH

SEQ ID NO: 21 - protein, 17 aa, Artificial Sequence
  Synthetic: 28F3 VH CDR2
VIWYEGSNKYYADSVKG

SEQ ID NO: 22 - protein, 15 aa, Artificial Sequence
  Synthetic: 28F3 VH CDR3
GGSMVRGDYYYGMDV

SEQ ID NO: 23 - protein, 11 aa, Artificial Sequence
  Synthetic: 28F3 VL CDR1
RASQGISSALA

SEQ ID NO: 24 - protein, 7 aa, Artificial Sequence
  Synthetic: 28F3 VL CDR2
DASSLES

SEQ ID NO: 25 - protein, 9 aa, Artificial Sequence
  Synthetic: 28F3 VL CDR3
QQFNSYPYT

SEQ ID NO: 26 - protein, 123 aa, Artificial Sequence
  Synthetic: 19D3 (VH)
QVQLVESGGGVVQPGRSLRLSCAASGFTFSSYGFHWVRQAPGKGLEWVAVIWYAGSNKFYADSVKGRFTISRDNSKNTLYLQMNSLRAEDTAVYYCARGGQLDYYYYYVMDVWGQGTTVTVSS

SEQ ID NO: 27 - protein, 107 aa, Artificial Sequence
  Synthetic: 19D3 (VL)
DIQMTQSPSSLSASVGDRVTITCRASQGISSWLAWYQQKPEKAPKSLIYAASSLQSGVPSRFSGSGSGTDFTLTISSLQPEDFATYYCQQYNSYPYTFGQGTKLEIK

SEQ ID NO: 28 - protein, 449 aa, Artificial Sequence
  Synthetic: 19D3 (full length wild-type heavy chain)
QVQLVESGGGVVQPGRSLRLSCAASGFTFSSYGFHWVRQAPGKGLEWVAVIWYAGSNKFYADSVKGRFTISRDNSKNTLYLQMNSLRAEDTAVYYCARGGQLDYYYYYVMDVWGQGTTVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 29 - protein, 214 aa, Artificial Sequence
  Synthetic: 19D3 (full length wild-type light chain)
DIQMTQSPSSLSASVGDRVTITCRASQGISSWLAWYQQKPEKAPKSLIYAASSLQSGVPSRFSGSGSGTDFTLTISSLQPEDFATYYCQQYNSYPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 30 - protein, 452 aa, Artificial Sequence
  Synthetic: 19D3.IgG1 (VH + IgG1)
QVQLVESGGGVVQPGRSLRLSCAASGFTFSSYGFHWVRQAPGKGLEWVAVIWYAGSNKFYADSVKGRFTISRDNSKNTLYLQMNSLRAEDTAVYYCARGGQLDYYYYYVMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 31 - protein, 452 aa, Artificial Sequence
  Synthetic: 19D3.IgG1.1 (VH + IgG1.1)
QVQLVESGGGVVQPGRSLRLSCAASGFTFSSYGFHWVRQAPGKGLEWVAVIWYAGSNKFYADSVKGRFTISRDNSKNTLYLQMNSLRAEDTAVYYCARGGQLDYYYYYVMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPSSIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 32 - protein, 214 aa, Artificial Sequence; identical to SEQ ID NO: 29
  Synthetic: 19D3.IgG1 (VL + CL)

SEQ ID NO: 33 - protein, 5 aa, Artificial Sequence
  Synthetic: 19D3 VH CDR1
SYGFH

SEQ ID NO: 34 - protein, 17 aa, Artificial Sequence
  Synthetic: 19D3 VH CDR2
VIWYAGSNKFYADSVKG

SEQ ID NO: 35 - protein, 14 aa, Artificial Sequence
  Synthetic: 19D3 VH CDR3
GGQLDYYYYYVMDV

SEQ ID NO: 36 - protein, 11 aa, Artificial Sequence
  Synthetic: 19D3 VL CDR1
RASQGISSWLA

SEQ ID NO: 37 - protein, 7 aa, Artificial Sequence
  Synthetic: 19D3 VL CDR2
AASSLQS

SEQ ID NO: 38 - protein, 9 aa, Artificial Sequence
  Synthetic: 19D3 VL CDR3
QQYNSYPYT

SEQ ID NO: 39 - protein, 123 aa, Artificial Sequence
  Synthetic: 18E10 (VH)
QVQLVESGGGVVQPGRSLRLSCAASGFTFSSYGMHWVRQAPGKGLEWVAVIWYAGSNKYYADSVKGRFTISRDNSKNTLYLQMNSLRAEDTAVYYCARGGRIAVAFYYSMDVWGQGTTVTVSS

SEQ ID NO: 40 - protein, 107 aa, Artificial Sequence; identical to SEQ ID NO: 27
  Synthetic: 18E10 (VL)

SEQ ID NO: 41 - protein, 449 aa, Artificial Sequence
  Synthetic: 18E10 (full length wild-type heavy chain)
QVQLVESGGGVVQPGRSLRLSCAASGFTFSSYGMHWVRQAPGKGLEWVAVIWYAGSNKYYADSVKGRFTISRDNSKNTLYLQMNSLRAEDTAVYYCARGGRIAVAFYYSMDVWGQGTTVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 42 - protein, 214 aa, Artificial Sequence; identical to SEQ ID NO: 29
  Synthetic: 18E10 (full length wild-type light chain)

SEQ ID NO: 43 - protein, 452 aa, Artificial Sequence
  Synthetic: 18E10.IgG1 (VH + IgG1)
QVQLVESGGGVVQPGRSLRLSCAASGFTFSSYGMHWVRQAPGKGLEWVAVIWYAGSNKYYADSVKGRFTISRDNSKNTLYLQMNSLRAEDTAVYYCARGGRIAVAFYYSMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 44 - protein, 452 aa, Artificial Sequence
  Synthetic: 18E10.IgG1.1 (VH + IgG1.1)
QVQLVESGGGVVQPGRSLRLSCAASGFTFSSYGMHWVRQAPGKGLEWVAVIWYAGSNKYYADSVKGRFTISRDNSKNTLYLQMNSLRAEDTAVYYCARGGRIAVAFYYSMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPSSIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 45 - protein, 214 aa, Artificial Sequence; identical to SEQ ID NO: 29
  Synthetic: 18E10.IgG1 (VL + CL)

SEQ ID NO: 46 - protein, 5 aa, Artificial Sequence
  Synthetic: 18E10 VH CDR1
SYGMH

SEQ ID NO: 47 - protein, 17 aa, Artificial Sequence
  Synthetic: 18E10 VH CDR2
VIWYAGSNKYYADSVKG

SEQ ID NO: 48 - protein, 14 aa, Artificial Sequence
  Synthetic: 18E10 VH CDR3
GGRIAVAFYYSMDV

SEQ ID NO: 49 - protein, 11 aa, Artificial Sequence
  Synthetic: 18E10 VL CDR1
RASQGISSWLA

SEQ ID NO: 50 - protein, 7 aa, Artificial Sequence
  Synthetic: 18E10 VL CDR2
AASSLQS

SEQ ID NO: 51 - protein, 9 aa, Artificial Sequence
  Synthetic: 18E10 VL CDR3
QQYNSYPYT

SEQ ID NO: 52 - protein, 117 aa, Artificial Sequence
  Synthetic: 3C3 (VH)
QVQLQQWGAGLLKPSETLSLTCAVYGGSFSGYYWTWIRQPPGKGLEWIGKINHSGNTNYNPSLKSRVTISVDTSKNQFSLKLSSVTAADTAVYYCARLGAFDAFDIWGQGTMVTVSS

SEQ ID NO: 53 - protein, 107 aa, Artificial Sequence; identical to SEQ ID NO: 27
  Synthetic: 3C3 (VL1)

SEQ ID NO: 54 - protein, 106 aa, Artificial Sequence
  Synthetic: 3C3 (VL2)
EIVLTQSPATLSLSPGERATLSCRASQGVSSYLAWYQQKPGQAPRLLIYDASNRATGIPARFSGSGPGTDFTLTISSLEPEDFAVYYCQQRSNWHTFGQGTKLEIK

SEQ ID NO: 55 - protein, 447 aa, Artificial Sequence
  Synthetic: 3C3 (full length wild-type heavy chain)
QVQLQQWGAGLLKPSETLSLTCAVYGGSFSGYYWTWIRQPPGKGLEWIGKINHSGNTNYNPSLKSRVTISVDTSKNQFSLKLSSVTAADTAVYYCARLGAFDAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 56 - protein, 214 aa, Artificial Sequence; identical to SEQ ID NO: 29
  Synthetic: 3C3 L1 (full length wild-type light chain 1)

SEQ ID NO: 57 - protein, 213 aa, Artificial Sequence
  Synthetic: 3C3 L2 (full length wild-type light chain 2)
EIVLTQSPATLSLSPGERATLSCRASQGVSSYLAWYQQKPGQAPRLLIYDASNRATGIPARFSGSGPGTDFTLTISSLEPEDFAVYYCQQRSNWHTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 58 - protein, 446 aa, Artificial Sequence
  Synthetic: 3C3.IgG1 (VH + IgG1)
QVQLQQWGAGLLKPSETLSLTCAVYGGSFSGYYWTWIRQPPGKGLEWIGKINHSGNTNYNPSLKSRVTISVDTSKNQFSLKLSSVTAADTAVYYCARLGAFDAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 59 - protein, 446 aa, Artificial Sequence
  Synthetic: 3C3.IgG1.1 (VH + IgG1.1)
QVQLQQWGAGLLKPSETLSLTCAVYGGSFSGYYWTWIRQPPGKGLEWIGKINHSGNTNYNPSLKSRVTISVDTSKNQFSLKLSSVTAADTAVYYCARLGAFDAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPSSIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 60 - protein, 214 aa, Artificial Sequence; identical to SEQ ID NO: 29
  Synthetic: 3C3.IgG1 (VL1 + CL)

SEQ ID NO: 61 - protein, 213 aa, Artificial Sequence; identical to SEQ ID NO: 57
  Synthetic: 3C3IgG1.2 (VL2 + CL)

SEQ ID NO: 62 - protein, 5 aa, Artificial Sequence
  Synthetic: 3C3 VH CDR1
GYYWT

SEQ ID NO: 63 - protein, 16 aa, Artificial Sequence
  Synthetic: 3C3 VH CDR2
KINHSGNTNYNPSLKS

SEQ ID NO: 64 - protein, 9 aa, Artificial Sequence
  Synthetic: 3C3 VH CDR3
LGAFDAFDI

SEQ ID NO: 65 - protein, 11 aa, Artificial Sequence
  Synthetic: 3C3 VL1 CDR1
RASQGISSWLA

SEQ ID NO: 66 - protein, 7 aa, Artificial Sequence
  Synthetic: 3C3 VL1 CDR2
AASSLQS

SEQ ID NO: 67 - protein, 9 aa, Artificial Sequence
  Synthetic: 3C3 VL1 CDR3
QQYNSYPYT

SEQ ID NO: 68 - protein, 11 aa, Artificial Sequence
  Synthetic: 3C3 VL2 CDR1
RASQGVSSYLA

SEQ ID NO: 69 - protein, 7 aa, Artificial Sequence
  Synthetic: 3C3 VL2 CDR2
DASNRAT

SEQ ID NO: 70 - protein, 8 aa, Artificial Sequence
  Synthetic: 3C3 VL2 CDR3
QQRSNWHT

SEQ ID NO: 71 - protein, 124 aa, Artificial Sequence
  Synthetic: 2G6 (VH)
QVQLVESGGGVVQPGGSLRLSCAASGFILSDYGMHWVRQAPGKGLEWVTVIWYDGSNKFYVDSVKGRFTISRDNSKNTLYLQMNSLRVEDTAVYYCARGGRLATGHFYYVMDVWGQGTTVTVSS

SEQ ID NO: 72 - protein, 107 aa, Artificial Sequence; identical to SEQ ID NO: 27
  Synthetic: 2G6 (VL)

SEQ ID NO: 73 - protein, 450 aa, Artificial Sequence
  Synthetic: 2G6 (full length wild-type heavy chain)
QVQLVESGGGVVQPGGSLRLSCAASGFILSDYGMHWVRQAPGKGLEWVTVIWYDGSNKFYVDSVKGRFTISRDNSKNTLYLQMNSLRVEDTAVYYCARGGRLATGHFYYVMDVWGQGTTVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 74 - protein, 214 aa, Artificial Sequence; identical to SEQ ID NO: 29
  Synthetic: 2G6 (full length wild-type light chain)

SEQ ID NO: 75 - protein, 453 aa, Artificial Sequence
  Synthetic: 2G6.IgG1 (VH + IgG1)
QVQLVESGGGVVQPGGSLRLSCAASGFILSDYGMHWVRQAPGKGLEWVTVIWYDGSNKFYVDSVKGRFTISRDNSKNTLYLQMNSLRVEDTAVYYCARGGRLATGHFYYVMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 76 - protein, 453 aa, Artificial Sequence
  Synthetic: 2G6.IgG1.1 (VH + IgG1.1)
QVQLVESGGGVVQPGGSLRLSCAASGFILSDYGMHWVRQAPGKGLEWVTVIWYDGSNKFYVDSVKGRFTISRDNSKNTLYLQMNSLRVEDTAVYYCARGGRLATGHFYYVMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPSSIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 77 - protein, 214 aa, Artificial Sequence; identical to SEQ ID NO: 29
  Synthetic: 2G6.IgG1 (VL + CL)

SEQ ID NO: 78 - protein, 5 aa, Artificial Sequence
  Synthetic: 2G6 VH CDR1
DYGMH

SEQ ID NO: 79 - protein, 17 aa, Artificial Sequence
  Synthetic: 2G6 VH CDR2
VIWYDGSNKFYVDSVKG

SEQ ID NO: 80 - protein, 15 aa, Artificial Sequence
  Synthetic: 2G6 VH CDR3
GGRLATGHFYYVMDV

SEQ ID NO: 81 - protein, 11 aa, Artificial Sequence
  Synthetic: 2G6 VL CDR1
RASQGISSWLA

SEQ ID NO: 82 - protein, 7 aa, Artificial Sequence
  Synthetic: 2G6 VL CDR2
AASSLQS

SEQ ID NO: 83 - protein, 9 aa, Artificial Sequence
  Synthetic: 2G6 VL CDR3
QQYNSYPYT

SEQ ID NO: 84 - protein, 124 aa, Artificial Sequence
  Synthetic: 8A6 (VH)
QVQLVESGGGVVQPGRSLRLSCTASGFTFSSYGMQWVRQAPGKGLEWVAVIWYEGSNKYYADSVKGRFTISRENSKNTLYLQMNSLRAEDTAVYYCARGGLMVRGLFYYGMDVWGQGTTVTVSS

SEQ ID NO: 85 - protein, 107 aa, Artificial Sequence
  Synthetic: 8A6 (VL)
AIQLTQSPSSLSASVGDRVTITCRASQGISSALAWYQQKPGKAPKFLIYDASSLESGVPSRFSGSGSGTDFTLTISSLQPEDFATYYCQQFNSYPYTFGQGTKLEIK

SEQ ID NO: 86 - protein, 450 aa, Artificial Sequence
  Synthetic: 8A6 (full length wild-type heavy chain)
QVQLVESGGGVVQPGRSLRLSCTASGFTFSSYGMQWVRQAPGKGLEWVAVIWYEGSNKYYADSVKGRFTISRENSKNTLYLQMNSLRAEDTAVYYCARGGLMVRGLFYYGMDVWGQGTTVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 87 - protein, 214 aa, Artificial Sequence
  Synthetic: 8A6 (full length wild-type light chain)
AIQLTQSPSSLSASVGDRVTITCRASQGISSALAWYQQKPGKAPKFLIYDASSLESGVPSRFSGSGSGTDFTLTISSLQPEDFATYYCQQFNSYPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 88 - protein, 453 aa, Artificial Sequence
  Synthetic: 8A6.IgG1 (VH + IgG1)
QVQLVESGGGVVQPGRSLRLSCTASGFTFSSYGMQWVRQAPGKGLEWVAVIWYEGSNKYYADSVKGRFTISRENSKNTLYLQMNSLRAEDTAVYYCARGGLMVRGLFYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 89 - protein, 453 aa, Artificial Sequence
  Synthetic: 8A6.IgG1.1 (VH + IgG1.1)
QVQLVESGGGVVQPGRSLRLSCTASGFTFSSYGMQWVRQAPGKGLEWVAVIWYEGSNKYYADSVKGRFTISRENSKNTLYLQMNSLRAEDTAVYYCARGGLMVRGLFYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPSSIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 90 - protein, 214 aa, Artificial Sequence; identical to SEQ ID NO: 87
  Synthetic: 8A6.IgG1 (VL + CL)

SEQ ID NO: 91 - protein, 5 aa, Artificial Sequence
  Synthetic: 8A6 VH CDR1
SYGMQ

SEQ ID NO: 92 - protein, 17 aa, Artificial Sequence
  Synthetic: 8A6 VH CDR2
VIWYEGSNKYYADSVKG

SEQ ID NO: 93 - protein, 15 aa, Artificial Sequence
  Synthetic: 8A6 VH CDR3
GGLMVRGLFYYGMDV

SEQ ID NO: 94 - protein, 11 aa, Artificial Sequence
  Synthetic: 8A6 VL CDR1
RASQGISSALA

SEQ ID NO: 95 - protein, 7 aa, Artificial Sequence
  Synthetic: 8A6 VL CDR2
DASSLES

SEQ ID NO: 96 - protein, 9 aa, Artificial Sequence
  Synthetic: 8A6 VL CDR3
QQFNSYPYT

SEQ ID NO: 97 - protein, 125 aa, Artificial Sequence
  Synthetic: 9G7 (VH)
EVQLVESGGGLVKPGGSLRLSCAASGFTFSTVWMSWVRQAPGKGLEWVGRIKSKTDGGTTDYAAPVKGRFTISRDDSKNTLYLQMNSLHTEDTAVYYCTTGQLIPYSYYYGMDVWGQGTSVTVSS

SEQ ID NO: 98 - protein, 108 aa, Artificial Sequence
  Synthetic: 9G7 (VL1)
EIVLTQSPGTLSLSPGERATLSCRASQSVSSSYLAWYQQKPGQAPRLLIYGASSRATGIPDRFSGSGSGTDFTLTISRLEPEDFAVYYCQQYGSSPWTFGQGTKVEIK

SEQ ID NO: 99 - protein, 108 aa, Artificial Sequence
  Synthetic: 9G7 (VL2)
EIVLTQSPGTLSLSPGERATLSCRASQSVTSSYLAWYQQKPGQAPRLLIYGASSRATGIPERFSGSGSGTDFTLTISRLEPEDFAVYYCQQYGSSPITFGQGTRLEIK

SEQ ID NO: 100 - protein, 452 aa, Artificial Sequence
  Synthetic: 9G7 (full length wild-type heavy chain)
EVQLVESGGGLVKPGGSLRLSCAASGFTFSTVWMSWVRQAPGKGLEWVGRIKSKTDGGTTDYAAPVKGRFTISRDDSKNTLYLQMNSLHTEDTAVYYCTTGQLIPYSYYYGMDVWGQGTSVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 101 - protein, 215 aa, Artificial Sequence
  Synthetic: 9G7 L2 (full length wild-type light chain 2)
EIVLTQSPGTLSLSPGERATLSCRASQSVTSSYLAWYQQKPGQAPRLLIYGASSRATGIPERFSGSGSGTDFTLTISRLEPEDFAVYYCQQYGSSPITFGQGTRLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 102 - protein, 454 aa, Artificial Sequence
  Synthetic: 9G7.IgG1 (VH + IgG1)
EVQLVESGGGLVKPGGSLRLSCAASGFTFSTVWMSWVRQAPGKGLEWVGRIKSKTDGGTTDYAAPVKGRFTISRDDSKNTLYLQMNSLHTEDTAVYYCTTGQLIPYSYYYGMDVWGQGTSVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 103 - protein, 454 aa, Artificial Sequence
  Synthetic: 9G7.IgG1.1 (VH + IgG1.1)
EVQLVESGGGLVKPGGSLRLSCAASGFTFSTVWMSWVRQAPGKGLEWVGRIKSKTDGGTTDYAAPVKGRFTISRDDSKNTLYLQMNSLHTEDTAVYYCTTGQLIPYSYYYGMDVWGQGTSVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPSSIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 104 - protein, 215 aa, Artificial Sequence
  Synthetic: 9G7.IgG1 (VL1 + CL)
EIVLTQSPGTLSLSPGERATLSCRASQSVSSSYLAWYQQKPGQAPRLLIYGASSRATGIPDRFSGSGSGTDFTLTISRLEPEDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 105 - protein, 215 aa, Artificial Sequence; identical to SEQ ID NO: 101
  Synthetic: 9G7.IgG1.2 (VL2 + CL)

SEQ ID NO: 106 - protein, 5 aa, Artificial Sequence
  Synthetic: 9G7 VH CDR1
TVWMS

SEQ ID NO: 107 - protein, 19 aa, Artificial Sequence
  Synthetic: 9G7 VH CDR2
RIKSKTDGGTTDYAAPVKG

SEQ ID NO: 108 - protein, 14 aa, Artificial Sequence
  Synthetic: 9G7 VH CDR3
GQLIPYSYYYGMDV

SEQ ID NO: 109 - protein, 12 aa, Artificial Sequence
  Synthetic: 9G7 VL1 CDR1
RASQSVSSSYLA

SEQ ID NO: 110 - protein, 7 aa, Artificial Sequence
  Synthetic: 9G7 VL1 CDR2
GASSRAT

SEQ ID NO: 111 - protein, 9 aa, Artificial Sequence
  Synthetic: 9G7 VL1 CDR3
QQYGSSPWT

SEQ ID NO: 112 - protein, 12 aa, Artificial Sequence
  Synthetic: 9G7 VL2 CDR1
RASQSVTSSYLA

SEQ ID NO: 113 - protein, 7 aa, Artificial Sequence
  Synthetic: 9G7 VL2 CDR2
GASSRAT

SEQ ID NO: 114 - protein, 9 aa, Artificial Sequence
  Synthetic: 9G7 VL2 CDR3
QQYGSSPIT

SEQ ID NO: 115 - protein, 117 aa, Artificial Sequence
  Synthetic: 14E3 (VH)
QVQLQQWGAGLLKPSETLSLTCAVYGGSFSGYYWSWIRQPPGKGLEWIGEINHSGNTYYNPSLKSRVTISVDTSKNQLSLKLSSVTAADTAVYYCARFGSNDAFDIWGQGTMVTVSS

SEQ ID NO: 116 - protein, 107 aa, Artificial Sequence
  Synthetic: 14E3 (VL)
DIQMTQSPSSLSASVGDRVTITCRASQGISSWLAWYQQKPEKAPKSLIYAASSLQSGVPSRFSGSGSGTDFTLTISSLQPEDFATYYCQQYNSYPPTFGQGTKVEIK

SEQ ID NO: 117 - protein, 447 aa, Artificial Sequence
  Synthetic: 14E3 (full length wild-type heavy chain)
QVQLQQWGAGLLKPSETLSLTCAVYGGSFSGYYWSWIRQPPGKGLEWIGEINHSGNTYYNPSLKSRVTISVDTSKNQLSLKLSSVTAADTAVYYCARFGSNDAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 118 - protein, 214 aa, Artificial Sequence
  Synthetic: 14E3 (full length wild-type light chain)
DIQMTQSPSSLSASVGDRVTITCRASQGISSWLAWYQQKPEKAPKSLIYAASSLQSGVPSRFSGSGSGTDFTLTISSLQPEDFATYYCQQYNSYPPTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 119 - protein, 446 aa, Artificial Sequence
  Synthetic: 14E3.IgG1 (VH + IgG1)
QVQLQQWGAGLLKPSETLSLTCAVYGGSFSGYYWSWIRQPPGKGLEWIGEINHSGNTYYNPSLKSRVTISVDTSKNQLSLKLSSVTAADTAVYYCARFGSNDAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 120 - protein, 446 aa, Artificial Sequence
  Synthetic: 14E3.IgG1.1 (VH + IgG1.1)
QVQLQQWGAGLLKPSETLSLTCAVYGGSFSGYYWSWIRQPPGKGLEWIGEINHSGNTYYNPSLKSRVTISVDTSKNQLSLKLSSVTAADTAVYYCARFGSNDAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPSSIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 121 - protein, 214 aa, Artificial Sequence; identical to SEQ ID NO: 118
  Synthetic: 14E3.IgG1 (VL + CL)

SEQ ID NO: 122 - protein, 5 aa, Artificial Sequence
  Synthetic: 14E3 VH CDR1
GYYWS

SEQ ID NO: 123 - protein, 16 aa, Artificial Sequence
  Synthetic: 14E3 VH CDR2
EINHSGNTYYNPSLKS

SEQ ID NO: 124 - protein, 9 aa, Artificial Sequence
  Synthetic: 14E3 VH CDR3
FGSNDAFDI

SEQ ID NO: 125 - protein, 11 aa, Artificial Sequence
  Synthetic: 14E3 VL CDR1
RASQGISSWLA

SEQ ID NO: 126 - protein, 7 aa, Artificial Sequence
  Synthetic: 14E3 VL CDR2
AASSLQS

SEQ ID NO: 127 - protein, 9 aa, Artificial Sequence
  Synthetic: 14E3 VL CDR3
QQYNSYPPT

SEQ ID NO: 128 - protein, 124 aa, Artificial Sequence
  Synthetic: 19H8 (VH)
QVQLVESGGGVVQPGRSLRLSCAASGFTFSNYGMHWVRQAPGKGLEWMAVIWYGGSNKFYADSVKGRFTISRDNSKNSLSLQMNSLRAEDTAVYYCARGGAMVRGVYYYGMDVWGQGTTVTVSS

SEQ ID NO: 129 - protein, 107 aa, Artificial Sequence
  Synthetic: 19H8 (VL1)
AIQLTQSPSSLSASVGDRVTITCRASQGISSALAWYQQKPGKAPKFLIYDASSLESGVPSRFSGSGSGTDFTLTISSLQPEDFATYYCQQFNSYPQTFGQGTKVEIK

SEQ ID NO: 130 - protein, 107 aa, Artificial Sequence
  Synthetic: 19H8 (VL2)
EIVLTQSPATLSLSPGERATLSCRASQSVSSYLAWYQQKPGQAPRLLIYDASNRATGIPARFSGSGSGTDFTLTISSLEPEDFAVYYCQQRSNWPLTFGGGTKVEIK

SEQ ID NO: 131 - protein, 450 aa, Artificial Sequence
  Synthetic: 19H8 (full length wild-type heavy chain)
QVQLVESGGGVVQPGRSLRLSCAASGFTFSNYGMHWVRQAPGKGLEWMAVIWYGGSNKFYADSVKGRFTISRDNSKNSLSLQMNSLRAEDTAVYYCARGGAMVRGVYYYGMDVWGQGTTVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 132 - protein, 214 aa, Artificial Sequence
  Synthetic: 19H8 L1 (full length wild-type light chain 1)
AIQLTQSPSSLSASVGDRVTITCRASQGISSALAWYQQKPGKAPKFLIYDASSLESGVPSRFSGSGSGTDFTLTISSLQPEDFATYYCQQFNSYPQTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 133 - protein, 214 aa, Artificial Sequence
  Synthetic: 19H8 L2 (full length wild-type light chain 2)
EIVLTQSPATLSLSPGERATLSCRASQSVSSYLAWYQQKPGQAPRLLIYDASNRATGIPARFSGSGSGTDFTLTISSLEPEDFAVYYCQQRSNWPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 134 - protein, 453 aa, Artificial Sequence
  Synthetic: 19H8.IgG1 (VH + IgG1)
QVQLVESGGGVVQPGRSLRLSCAASGFTFSNYGMHWVRQAPGKGLEWMAVIWYGGSNKFYADSVKGRFTISRDNSKNSLSLQMNSLRAEDTAVYYCARGGAMVRGVYYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 135 - protein, 453 aa, Artificial Sequence
  Synthetic: 19H8.IgG1.1 (VH + IgG1.1)
QVQLVESGGGVVQPGRSLRLSCAASGFTFSNYGMHWVRQAPGKGLEWMAVIWYGGSNKFYADSVKGRFTISRDNSKNSLSLQMNSLRAEDTAVYYCARGGAMVRGVYYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPSSIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 136 - protein, 214 aa, Artificial Sequence; identical to SEQ ID NO: 132
  Synthetic: 19H8.IgG1 (VL1 + CL)

SEQ ID NO: 137 - protein, 214 aa, Artificial Sequence; identical to SEQ ID NO: 133
  Synthetic: 19H8.IgG1.2 (VL2 + CL)

SEQ ID NO: 138 - protein, 5 aa, Artificial Sequence
  Synthetic: 19H8 VH CDR1
NYGMH

SEQ ID NO: 139 - protein, 17 aa, Artificial Sequence
  Synthetic: 19H8 VH CDR2
VIWYGGSNKFYADSVKG

SEQ ID NO: 140 - protein, 15 aa, Artificial Sequence
  Synthetic: 19H8 VH CDR3
GGAMVRGVYYYGMDV

SEQ ID NO: 141 - protein, 11 aa, Artificial Sequence
  Synthetic: 19H8 VL1 CDR1
RASQGISSALA

SEQ ID NO: 142 - protein, 7 aa, Artificial Sequence
  Synthetic: 19H8 VL1 CDR2
DASSLES

SEQ ID NO: 143 - protein, 9 aa, Artificial Sequence
  Synthetic: 19H8 VL1 CDR3
QQFNSYPQT

SEQ ID NO: 144 - protein, 11 aa, Artificial Sequence
  Synthetic: 19H8 VL2 CDR1
RASQSVSSYLA

SEQ ID NO: 145 - protein, 7 aa, Artificial Sequence
  Synthetic: 19H8 VL2 CDR2
DASNRAT

SEQ ID NO: 146 - protein, 9 aa, Artificial Sequence
  Synthetic: 19H8 VL2 CDR3
QQRSNWPLT

SEQ ID NO: 147 - DNA, 372 bp, Artificial Sequence
  Synthetic: 28F3 (VH) nucleotide sequence
caggtgcagctggtggagtctgggggaggcgtggtccagcctgggaggtccctgagactctcctgtgcagcgtctggattcaccttcagtagctatggcatgcactgggtccgccaggctccaggcaaggggctggagtgggtggcagttatatggtatgaaggaagtaataaatattatgcagactccgtgaagggccgattcaccatctccagagacaattccaagaacacgctgtatctgcaaatgaacagcctgagagccgaggacacggctgtgtattactgtgcgagaggggggagtatggttcggggggactactactacggtatggacgtctggggccaagggaccacggtcaccgtctcctca

SEQ ID NO: 148 - DNA, 321 bp, Artificial Sequence
  Synthetic: 28F3 (VL) nucleotide sequence
gccatccagttgacccagtctccatcctccctgtctgcatctgtaggagacagagtcaccatcacttgccgggcaagtcagggcattagcagtgctttagcctggtatcagcagaaaccagggaaagctcctaagctcctgatctatgatgcctccagtttggaaagtggggtcccatcaaggttcagcggcagtggatctgggacagatttcactctcaccatcagcagcctgcagcctgaagattttgcaacttattactgtcaacagtttaatagttacccgtacacttttggccaggggaccaagctggagatcaaa

SEQ ID NO: 149 - DNA, 1350 bp, Artificial Sequence
  Synthetic: 28F3 (full length wild-type heavy chain) nucleotide sequence
caggtgcagctggtggagtctgggggaggcgtggtccagcctgggaggtccctgagactctcctgtgcagcgtctggattcaccttcagtagctatggcatgcactgggtccgccaggctccaggcaaggggctggagtgggtggcagttatatggtatgaaggaagtaataaatattatgcagactccgtgaagggccgattcaccatctccagagacaattccaagaacacgctgtatctgcaaatgaacagcctgagagccgaggacacggctgtgtattactgtgcgagaggggggagtatggttcggggggactactactacggtatggacgtctggggccaagggaccacggtcaccgtctcctcagcctccaccaagggcccatcggtcttccccctggcgccctgctccaggagcacctccgagagcacagcggccctgggctgcctggtcaaggactacttccccgaaccggtgacggtgtcgtggaactcaggcgctctgaccagcggcgtgcacaccttcccagctgtcctacagtcctcaggactctactccctcagcagcgtggtgaccgtgccctccagcaacttcggcacccagacctacacctgcaacgtagatcacaagcccagcaacaccaaggtggacaagacagttgagcgcaaatgttgtgtcgagtgcccaccgtgcccagcaccacctgtggcaggaccgtcagtcttcctcttccccccaaaacccaaggacaccctcatgatctcccggacccctgaggtcacgtgcgtggtggtggacgtgagccacgaagaccccgaggtccagttcaactggtacgtggacggcgtggaggtgcataatgccaagacaaagccacgggaggagcagttcaacagcacgttccgtgtggtcagcgtcctcaccgttgtgcaccaggactggctgaacggcaaggagtacaagtgcaaggtctccaacaaaggcctcccagcccccatcgagaaaaccatctccaaaaccaaagggcagccccgagaaccacaggtgtacaccctgcccccatcccgggaggagatgaccaagaaccaggtcagcctgacctgcctggtcaaaggcttctaccccagcgacatcgccgtggagtgggagagcaatgggcagccggagaacaactacaagaccacacctcccatgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 150 - DNA, 642 bp, Artificial Sequence
  Synthetic: 28F3 (full length wild-type light chain) nucleotide sequence
gccatccagttgacccagtctccatcctccctgtctgcatctgtaggagacagagtcaccatcacttgccgggcaagtcagggcattagcagtgctttagcctggtatcagcagaaaccagggaaagctcctaagctcctgatctatgatgcctccagtttggaaagtggggtcccatcaaggttcagcggcagtggatctgggacagatttcactctcaccatcagcagcctgcagcctgaagattttgcaacttattactgtcaacagtttaatagttacccgtacacttttggccaggggaccaagctggagatcaaacgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 151 - DNA, 1362 bp, Artificial Sequence
  Synthetic: 28F3.IgG1 (VH + IgG1) nucleotide sequence
caggtgcagctggtggagtctgggggaggcgtggtccagcctgggaggtccctgagactctcctgtgcagcgtctggattcaccttcagtagctatggcatgcactgggtccgccaggctccaggcaaggggctggagtgggtggcagttatatggtatgaaggaagtaataaatattatgcagactccgtgaagggccgattcaccatctccagagacaattccaagaacacgctgtatctgcaaatgaacagcctgagagccgaggacacggctgtgtattactgtgcgagaggggggagtatggttcggggggactactactacggtatggacgtctggggccaagggaccacggtcaccgtctcctcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtccccgggttga

SEQ ID NO: 152 - DNA, 1362 bp, Artificial Sequence
  Synthetic: 28F3.IgG1.1 (VH + IgG1.1) nucleotide sequence
caggtgcagctggtggagtctgggggaggcgtggtccagcctgggaggtccctgagactctcctgtgcagcgtctggattcaccttcagtagctatggcatgcactgggtccgccaggctccaggcaaggggctggagtgggtggcagttatatggtatgaaggaagtaataaatattatgcagactccgtgaagggccgattcaccatctccagagacaattccaagaacacgctgtatctgcaaatgaacagcctgagagccgaggacacggctgtgtattactgtgcgagaggggggagtatggttcggggggactactactacggtatggacgtctggggccaagggaccacggtcaccgtctcctcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaagccgaaggggccccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccaagcagcatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtccccgggttga

SEQ ID NO: 153 - DNA, 645 bp, Artificial Sequence
  Synthetic: 28F3.IgG1 (VL + CL) nucleotide sequence
gccatccagttgacccagtctccatcctccctgtctgcatctgtaggagacagagtcaccatcacttgccgggcaagtcagggcattagcagtgctttagcctggtatcagcagaaaccagggaaagctcctaagctcctgatctatgatgcctccagtttggaaagtggggtcccatcaaggttcagcggcagtggatctgggacagatttcactctcaccatcagcagcctgcagcctgaagattttgcaacttattactgtcaacagtttaatagttacccgtacacttttggccaggggaccaagctggagatcaaacgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttag

SEQ ID NO: 154 - DNA, 369 bp, Artificial Sequence
  Synthetic: 19D3 (VH) nucleotide sequence
caggtgcagctggtggagtctgggggaggcgtggtccaacctgggaggtccctgagactctcctgtgcagcgtctggattcaccttcagtagctatggcttccactgggtccgccaggctccaggcaaggggctggagtgggtggcagttatatggtatgctggaagtaataaattctatgcagactccgtgaagggccgattcaccatctccagagacaattccaagaacacgctgtatctgcaaatgaacagcctaagagccgaggacacggctgtgtattactgtgcgagagggggacagttggactactactactattacgttatggacgtctggggccaagggaccacggtcaccgtctcctca

SEQ ID NO: 155 - DNA, 321 bp, Artificial Sequence
  Synthetic: 19D3 (VL) nucleotide sequence
gacatccagatgacccagtctccatcctcactgtctgcatctgtaggagacagagtcaccatcacttgtcgggcgagtcagggtattagcagctggttagcctggtatcagcagaaaccagagaaagcccctaagtccctgatctatgctgcatccagtttgcaaagtggggtcccatcaaggttcagcggcagtggatctgggacagatttcactctcaccatcagcagcctgcagcctgaagattttgcaacttattactgccaacagtataatagttacccgtacacttttggccaggggaccaagctggagatcaaa

SEQ ID NO: 156 - DNA, 1347 bp, Artificial Sequence
  Synthetic: 19D3 (full length wild-type heavy chain) nucleotide sequence
caggtgcagctggtggagtctgggggaggcgtggtccaacctgggaggtccctgagactctcctgtgcagcgtctggattcaccttcagtagctatggcttccactgggtccgccaggctccaggcaaggggctggagtgggtggcagttatatggtatgctggaagtaataaattctatgcagactccgtgaagggccgattcaccatctccagagacaattccaagaacacgctgtatctgcaaatgaacagcctaagagccgaggacacggctgtgtattactgtgcgagagggggacagttggactactactactattacgttatggacgtctggggccaagggaccacggtcaccgtctcctcagcctccaccaagggcccatcggtcttccccctggcgccctgctccaggagcacctccgagagcacagcggccctgggctgcctggtcaaggactacttccccgaaccggtgacggtgtcgtggaactcaggcgctctgaccagcggcgtgcacaccttcccagctgtcctacagtcctcaggactctactccctcagcagcgtggtgaccgtgccctccagcaacttcggcacccagacctacacctgcaacgtagatcacaagcccagcaacaccaaggtggacaagacagttgagcgcaaatgttgtgtcgagtgcccaccgtgcccagcaccacctgtggcaggaccgtcagtcttcctcttccccccaaaacccaaggacaccctcatgatctcccggacccctgaggtcacgtgcgtggtggtggacgtgagccacgaagaccccgaggtccagttcaactggtacgtggacggcgtggaggtgcataatgccaagacaaagccacgggaggagcagttcaacagcacgttccgtgtggtcagcgtcctcaccgttgtgcaccaggactggctgaacggcaaggagtacaagtgcaaggtctccaacaaaggcctcccagcccccatcgagaaaaccatctccaaaaccaaagggcagccccgagaaccacaggtgtacaccctgcccccatcccgggaggagatgaccaagaaccaggtcagcctgacctgcctggtcaaaggcttctaccccagcgacatcgccgtggagtgggagagcaatgggcagccggagaacaactacaagaccacacctcccatgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 157 - DNA, 642 bp, Artificial Sequence
  Synthetic: 19D3 (full length wild-type light chain) nucleotide sequence
gacatccagatgacccagtctccatcctcactgtctgcatctgtaggagacagagtcaccatcacttgtcgggcgagtcagggtattagcagctggttagcctggtatcagcagaaaccagagaaagcccctaagtccctgatctatgctgcatccagtttgcaaagtggggtcccatcaaggttcagcggcagtggatctgggacagatttcactctcaccatcagcagcctgcagcctgaagattttgcaacttattactgccaacagtataatagttacccgtacacttttggccaggggaccaagctggagatcaaacgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 158 - DNA, 369 bp, Artificial Sequence
  Synthetic: 18E10 (VH) nucleotide sequence
caggtgcagctggtggagtctgggggaggcgtggtccagcctgggaggtccctgagactctcctgtgcagcgtctggattcaccttcagtagctatggcatgcactgggtccgccaggctccaggcaaggggctggagtgggtggcagttatatggtatgctggaagtaataaatactatgcagactccgtgaagggccgattcaccatctccagagacaattccaagaacacgctgtatctgcaaatgaacagcctgagagccgaggacacggctgtgtattactgtgcgagaggggggcgtatagcagtggccttctactacagtatggacgtctggggccaagggaccacggtcaccgtctcctca

SEQ ID NO: 159 - DNA, 321 bp, Artificial Sequence; identical to SEQ ID NO: 155
  Synthetic: 18E10 (VL) nucleotide sequence

SEQ ID NO: 160 - DNA, 1347 bp, Artificial Sequence
  Synthetic: 18E10 (full length wild-type heavy chain) nucleotide sequence
caggtgcagctggtggagtctgggggaggcgtggtccagcctgggaggtccctgagactctcctgtgcagcgtctggattcaccttcagtagctatggcatgcactgggtccgccaggctccaggcaaggggctggagtgggtggcagttatatggtatgctggaagtaataaatactatgcagactccgtgaagggccgattcaccatctccagagacaattccaagaacacgctgtatctgcaaatgaacagcctgagagccgaggacacggctgtgtattactgtgcgagaggggggcgtatagcagtggccttctactacagtatggacgtctggggccaagggaccacggtcaccgtctcctcagcctccaccaagggcccatcggtcttccccctggcgccctgctccaggagcacctccgagagcacagcggccctgggctgcctggtcaaggactacttccccgaaccggtgacggtgtcgtggaactcaggcgctctgaccagcggcgtgcacaccttcccagctgtcctacagtcctcaggactctactccctcagcagcgtggtgaccgtgccctccagcaacttcggcacccagacctacacctgcaacgtagatcacaagcccagcaacaccaaggtggacaagacagttgagcgcaaatgttgtgtcgagtgcccaccgtgcccagcaccacctgtggcaggaccgtcagtcttcctcttccccccaaaacccaaggacaccctcatgatctcccggacccctgaggtcacgtgcgtggtggtggacgtgagccacgaagaccccgaggtccagttcaactggtacgtggacggcgtggaggtgcataatgccaagacaaagccacgggaggagcagttcaacagcacgttccgtgtggtcagcgtcctcaccgttgtgcaccaggactggctgaacggcaaggagtacaagtgcaaggtctccaacaaaggcctcccagcccccatcgagaaaaccatctccaaaaccaaagggcagccccgagaaccacaggtgtacaccctgcccccatcccgggaggagatgaccaagaaccaggtcagcctgacctgcctggtcaaaggcttctaccccagcgacatcgccgtggagtgggagagcaatgggcagccggagaacaactacaagaccacacctcccatgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 161 - DNA, 642 bp, Artificial Sequence; identical to SEQ ID NO: 157
  Synthetic: 18E10 (full length wild-type light chain) nucleotide sequence

SEQ ID NO: 162 - DNA, 351 bp, Artificial Sequence
  Synthetic: 3C3 (VH) nucleotide sequence
caggtgcaactacagcagtggggcgcaggactgttgaagccttcggagaccctgtccctcacctgcgctgtctatggtgggtccttcagtggttactactggacctggatccgccagcccccagggaaggggctggagtggattgggaaaatcaatcatagtggaaacaccaactacaacccgtccctcaagagtcgagtcaccatatcagtagacacgtccaagaaccagttctccctgaagctgagctctgtgaccgccgcggacacggctgtgtattactgtgcgagactgggggcctttgatgcttttgatatctggggccaagggacaatggtcaccgtctcttca

SEQ ID NO: 163 - DNA, 321 bp, Artificial Sequence; identical to SEQ ID NO: 155
  Synthetic: 3C3 (VL1) nucleotide sequence

SEQ ID NO: 164 - DNA, 318 bp, Artificial Sequence
  Synthetic: 3C3 (VL2) nucleotide sequence
gaaattgtgttgacacagtctccagccaccctgtctttgtctccaggggaaagagccaccctctcctgcagggccagtcagggtgttagcagctacttagcctggtaccagcagaaacctggccaggctcccaggctcctcatctatgatgcatccaacagggccactggcatcccagccaggttcagtggcagtgggcctgggacagacttcactctcaccatcagcagcctagagcctgaagattttgcagtttattactgtcagcagcgtagcaactggcacacttttggccaggggaccaagctggagatcaaa

SEQ ID NO: 165 - DNA, 1341 bp, Artificial Sequence
  Synthetic: 3C3 (full length wild-type heavy chain) nucleotide sequence
caggtgcaactacagcagtggggcgcaggactgttgaagccttcggagaccctgtccctcacctgcgctgtctatggtgggtccttcagtggttactactggacctggatccgccagcccccagggaaggggctggagtggattgggaaaatcaatcatagtggaaacaccaactacaacccgtccctcaagagtcgagtcaccatatcagtagacacgtccaagaaccagttctccctgaagctgagctctgtgaccgccgcggacacggctgtgtattactgtgcgagactgggggcctttgatgcttttgatatctggggccaagggacaatggtcaccgtctcttcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 166 - DNA, 642 bp, Artificial Sequence; identical to SEQ ID NO: 157
  Synthetic: 3C3 L1 (full length wild-type light chain) nucleotide sequence

SEQ ID NO: 167 - DNA, 639 bp, Artificial Sequence
  Synthetic: 3C3 L2 (full length wild-type light chain) nucleotide sequence
gaaattgtgttgacacagtctccagccaccctgtctttgtctccaggggaaagagccaccctctcctgcagggccagtcagggtgttagcagctacttagcctggtaccagcagaaacctggccaggctcccaggctcctcatctatgatgcatccaacagggccactggcatcccagccaggttcagtggcagtgggcctgggacagacttcactctcaccatcagcagcctagagcctgaagattttgcagtttattactgtcagcagcgtagcaactggcacacttttggccaggggaccaagctggagatcaaacgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 168 - DNA, 372 bp, Artificial Sequence
  Synthetic: 2G6 (VH) nucleotide sequence
caggttcagctggtggagtctgggggaggcgtggtccagcctggggggtccctgagactctcctgtgcagcgtctggattcatcttgagtgactatggcatgcactgggtccgccaggctccaggcaagggactggagtgggtgacagttatctggtatgatggaagtaataaattctatgtagactccgtgaagggccgattcaccatctccagagacaattccaagaacacgttgtatctgcaaatgaacagcctgagagtcgaggacacggctgtgtattactgtgcgagagggggacgtctagcaacaggtcacttctactacgttatggacgtctggggccaagggaccacggtcaccgtctcctca

SEQ ID NO: 169 - DNA, 321 bp, Artificial Sequence; identical to SEQ ID NO: 155
  Synthetic: 2G6 (VL) nucleotide sequence

SEQ ID NO: 170 - DNA, 1350 bp, Artificial Sequence
  Synthetic: 2G6 (full length wild-type heavy chain) nucleotide sequence
caggttcagctggtggagtctgggggaggcgtggtccagcctggggggtccctgagactctcctgtgcagcgtctggattcatcttgagtgactatggcatgcactgggtccgccaggctccaggcaagggactggagtgggtgacagttatctggtatgatggaagtaataaattctatgtagactccgtgaagggccgattcaccatctccagagacaattccaagaacacgttgtatctgcaaatgaacagcctgagagtcgaggacacggctgtgtattactgtgcgagagggggacgtctagcaacaggtcacttctactacgttatggacgtctggggccaagggaccacggtcaccgtctcctcagcctccaccaagggcccatcggtcttccccctggcgccctgctccaggagcacctccgagagcacagcggccctgggctgcctggtcaaggactacttccccgaaccggtgacggtgtcgtggaactcaggcgctctgaccagcggcgtgcacaccttcccagctgtcctacagtcctcaggactctactccctcagcagcgtggtgaccgtgccctccagcaacttcggcacccagacctacacctgcaacgtagatcacaagcccagcaacaccaaggtggacaagacagttgagcgcaaatgttgtgtcgagtgcccaccgtgcccagcaccacctgtggcaggaccgtcagtcttcctcttccccccaaaacccaaggacaccctcatgatctcccggacccctgaggtcacgtgcgtggtggtggacgtgagccacgaagaccccgaggtccagttcaactggtacgtggacggcgtggaggtgcataatgccaagacaaagccacgggaggagcagttcaacagcacgttccgtgtggtcagcgtcctcaccgttgtgcaccaggactggctgaacggcaaggagtacaagtgcaaggtctccaacaaaggcctcccagcccccatcgagaaaaccatctccaaaaccaaagggcagccccgagaaccacaggtgtacaccctgcccccatcccgggaggagatgaccaagaaccaggtcagcctgacctgcctggtcaaaggcttctaccccagcgacatcgccgtggagtgggagagcaatgggcagccggagaacaactacaagaccacacctcccatgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 171 - DNA, 642 bp, Artificial Sequence; identical to SEQ ID NO: 157
  Synthetic: 2G6 (full length wild-type light chain) nucleotide sequence

SEQ ID NO: 172 - DNA, 372 bp, Artificial Sequence
  Synthetic: 8A6 (VH) nucleotide sequence
caggtgcagctggtggagtctgggggaggcgtggtccagcctgggaggtccctgagactctcctgtacagcgtctggattcaccttcagtagctatggcatgcagtgggtccgccaggctccaggcaaggggctggagtgggtggcagttatatggtatgaaggaagtaataaatactatgcagactccgtgaagggccgattcaccatctccagagaaaattccaagaacacgctgtatctgcaaatgaacagcctgagagccgaggacacggctgtgtattactgtgcgagaggcggtcttatggttcggggtctcttctactacggtatggacgtctggggccaagggaccacggtcaccgtctcctca

SEQ ID NO: 173 - DNA, 321 bp, Artificial Sequence
  Synthetic: 8A6 (VL) nucleotide sequence
gccatccagttgacccagtctccatcctccctgtctgcatctgtaggagacagagtcaccatcacttgccgggcaagtcagggcattagcagtgctttagcctggtatcagcagaaaccagggaaagctcctaagttcctgatctatgatgcctccagtttggaaagtggggtcccatcaaggttcagcggcagtggatctgggacagatttcactctcaccatcagcagcctgcagcctgaagattttgcaacttattactgtcaacagtttaatagttacccgtacacttttggccaggggaccaagctggagatcaaa

SEQ ID NO: 174 - DNA, 1350 bp, Artificial Sequence
  Synthetic: 8A6 (full length wild-type heavy chain) nucleotide sequence
caggtgcagctggtggagtctgggggaggcgtggtccagcctgggaggtccctgagactctcctgtacagcgtctggattcaccttcagtagctatggcatgcagtgggtccgccaggctccaggcaaggggctggagtgggtggcagttatatggtatgaaggaagtaataaatactatgcagactccgtgaagggccgattcaccatctccagagaaaattccaagaacacgctgtatctgcaaatgaacagcctgagagccgaggacacggctgtgtattactgtgcgagaggcggtcttatggttcggggtctcttctactacggtatggacgtctggggccaagggaccacggtcaccgtctcctcagcctccaccaagggcccatcggtcttccccctggcgccctgctccaggagcacctccgagagcacagcggccctgggctgcctggtcaaggactacttccccgaaccggtgacggtgtcgtggaactcaggcgctctgaccagcggcgtgcacaccttcccagctgtcctacagtcctcaggactctactccctcagcagcgtggtgaccgtgccctccagcaacttcggcacccagacctacacctgcaacgtagatcacaagcccagcaacaccaaggtggacaagacagttgagcgcaaatgttgtgtcgagtgcccaccgtgcccagcaccacctgtggcaggaccgtcagtcttcctcttccccccaaaacccaaggacaccctcatgatctcccggacccctgaggtcacgtgcgtggtggtggacgtgagccacgaagaccccgaggtccagttcaactggtacgtggacggcgtggaggtgcataatgccaagacaaagccacgggaggagcagttcaacagcacgttccgtgtggtcagcgtcctcaccgttgtgcaccaggactggctgaacggcaaggagtacaagtgcaaggtctccaacaaaggcctcccagcccccatcgagaaaaccatctccaaaaccaaagggcagccccgagaaccacaggtgtacaccctgcccccatcccgggaggagatgaccaagaaccaggtcagcctgacctgcctggtcaaaggcttctaccccagcgacatcgccgtggagtgggagagcaatgggcagccggagaacaactacaagaccacacctcccatgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 175 - DNA, 642 bp, Artificial Sequence
  Synthetic: 8A6 (full length wild-type light chain) nucleotide sequence
gccatccagttgacccagtctccatcctccctgtctgcatctgtaggagacagagtcaccatcacttgccgggcaagtcagggcattagcagtgctttagcctggtatcagcagaaaccagggaaagctcctaagttcctgatctatgatgcctccagtttggaaagtggggtcccatcaaggttcagcggcagtggatctgggacagatttcactctcaccatcagcagcctgcagcctgaagattttgcaacttattactgtcaacagtttaatagttacccgtacacttttggccaggggaccaagctggagatcaaacgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 176 - DNA, 375 bp, Artificial Sequence
  Synthetic: 9G7 (VH) nucleotide sequence
gaggtgcagctggtggagtctgggggaggcttagtaaagcctggggggtcccttagactctcctgtgcagcctctggattcactttcagtaccgtctggatgagctgggtccgccaggctccagggaaggggctggagtgggttggccgtattaaaagcaaaactgatggtgggacaacagactacgctgcacccgtgaaaggcagattcaccatctcaagagatgattcaaaaaacacgctgtatctgcaaatgaacagcctgcacaccgaggacacagccgtgtattactgtaccacagggcagctgatcccttactcctactactacggtatggacgtctggggccaagggacctcggtcaccgtctcctca

SEQ ID NO: 177 - DNA, 324 bp, Artificial Sequence
  Synthetic: 9G7 (VL1) nucleotide sequence
gaaattgtgttgacgcagtctccaggcaccctgtctttgtctccaggggaaagagccaccctctcctgcagggccagtcagagtgttagcagcagctacttagcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcagtgtattactgtcagcagtatggtagctcaccgtggacgttcggccaagggaccaaggtggaaatcaaa

SEQ ID NO: 178 - DNA, 324 bp, Artificial Sequence
  Synthetic: 9G7 (VL2) nucleotide sequence
gaaattgtgttgacgcagtctccaggcaccctgtctttgtctccaggggaaagagccaccctctcctgcagggccagtcagagtgttaccagcagctacttagcctggtaccagcagaaacctggccaggctcccaggctcctcatctatggtgcatccagcagggccactggcatcccagagaggttcagtggcagtgggtctgggacagacttcactctcaccatcagcagactggagcctgaagattttgcagtgtattactgtcagcagtatggtagctcaccgatcaccttcggccaagggacacgactggagattaaa

SEQ ID NO: 179 - DNA, 1356 bp, Artificial Sequence
  Synthetic: 9G7 (full length wild-type heavy chain) nucleotide sequence
gaggtgcagctggtggagtctgggggaggcttagtaaagcctggggggtcccttagactctcctgtgcagcctctggattcactttcagtaccgtctggatgagctgggtccgccaggctccagggaaggggctggagtgggttggccgtattaaaagcaaaactgatggtgggacaacagactacgctgcacccgtgaaaggcagattcaccatctcaagagatgattcaaaaaacacgctgtatctgcaaatgaacagcctgcacaccgaggacacagccgtgtattactgtaccacagggcagctgatcccttactcctactactacggtatggacgtctggggccaagggacctcggtcaccgtctcctcagcttccaccaagggcccatccgtcttccccctggcgccctgctccaggagcacctccgagagcacagccgccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacgaagacctacacctgcaacgtagatcacaagcccagcaacaccaaggtggacaagagagttgagtccaaatatggtcccccatgcccatcatgcccagcacctgagttcctggggggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaggctaaccgtggacaagagcaggtggcaggaggggaatgtcttctcatgctccgtgatgcatgaggctctgcacaaccactacacacagaagagcctctccctgtctctgggtaaa

SEQ ID NO: 180 - DNA, 645 bp, Artificial Sequence
  Synthetic: 9G7 L2 (full length wild-type light chain) nucleotide sequence
gaaattgtgttgacgcagtctccaggcaccctgtctttgtctccaggggaaagagccaccctctcctgcagggccagtcagagtgttaccagcagctacttagcctggtaccagcagaaacctggccaggctcccaggctcctcatctatggtgcatccagcagggccactggcatcccagagaggttcagtggcagtgggtctgggacagacttcactctcaccatcagcagactggagcctgaagattttgcagtgtattactgtcagcagtatggtagctcaccgatcaccttcggccaagggacacgactggagattaaacgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 181 - DNA, 645 bp, Artificial Sequence
  Synthetic: 9G7 L1 (full length wild-type light chain) nucleotide sequence
gaaattgtgttgacgcagtctccaggcaccctgtctttgtctccaggggaaagagccaccctctcctgcagggccagtcagagtgttagcagcagctacttagcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcagtgtattactgtcagcagtatggtagctcaccgtggacgttcggccaagggaccaaggtggaaatcaaacgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 182 - DNA, 351 bp, Artificial Sequence
  Synthetic: 14E3 (VH) nucleotide sequence
caggtgcagctacagcagtggggcgcaggactgttgaagccttcggagaccctgtccctcacctgcgctgtctatggtgggtccttcagtggttactactggagctggatccgccagcccccagggaaggggctggagtggattggagaaatcaatcatagtggaaacacctactacaacccgtccctcaagagtcgcgtcaccatatcagtagacacgtccaagaaccagttatccctgaagctgagctctgtgaccgccgcggacacggctgtgtattactgtgcgagatttgggagtaatgatgcttttgatatctggggccaagggacaatggtcaccgtctcttca

SEQ ID NO: 183 - DNA, 321 bp, Artificial Sequence
  Synthetic: 14E3 (VL) nucleotide sequence
gacatccagatgacccagtctccatcctcactgtctgcatctgtaggagacagagtcaccatcacttgtcgggcgagtcagggtattagcagctggttagcctggtatcagcagaaaccagagaaagcccctaagtccctgatctatgctgcatccagtttgcaaagtggggtcccatcaaggttcagcggcagtggatctgggacagatttcactctcaccatcagcagcctgcagcctgaagattttgcaacttattactgccaacagtataatagttaccctccgacgttcggccaagggaccaaggtggaaatcaaa

SEQ ID NO: 184 - DNA, 1341 bp, Artificial Sequence
  Synthetic: 14E3 (full length wild-type heavy chain) nucleotide sequence
caggtgcagctacagcagtggggcgcaggactgttgaagccttcggagaccctgtccctcacctgcgctgtctatggtgggtccttcagtggttactactggagctggatccgccagcccccagggaaggggctggagtggattggagaaatcaatcatagtggaaacacctactacaacccgtccctcaagagtcgcgtcaccatatcagtagacacgtccaagaaccagttatccctgaagctgagctctgtgaccgccgcggacacggctgtgtattactgtgcgagatttgggagtaatgatgcttttgatatctggggccaagggacaatggtcaccgtctcttcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 185 - DNA, 642 bp, Artificial Sequence
  Synthetic: 14E3 (full length wild-type light chain) nucleotide sequence
gacatccagatgacccagtctccatcctcactgtctgcatctgtaggagacagagtcaccatcacttgtcgggcgagtcagggtattagcagctggttagcctggtatcagcagaaaccagagaaagcccctaagtccctgatctatgctgcatccagtttgcaaagtggggtcccatcaaggttcagcggcagtggatctgggacagatttcactctcaccatcagcagcctgcagcctgaagattttgcaacttattactgccaacagtataatagttaccctccgacgttcggccaagggaccaaggtggaaatcaaacgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 186 - DNA, 372 bp, Artificial Sequence
  Synthetic: 19H8 (VH) nucleotide sequence
caggtgcagctggtggagtctgggggaggcgtggtccagcctgggaggtccctgagactctcctgtgcagcgtctggattcaccttcagtaactatggcatgcactgggtccgccaggctccaggcaaggggctggagtggatggcagttatatggtatggtggaagtaataaattctatgcagactccgtgaagggccgattcaccatctccagagacaattccaagaactcgctgtctctgcaaatgaacagcctgagagccgaggacacggctgtgtattactgtgcgagagggggggctatggttcggggagtctactactacggtatggacgtctggggccaagggaccacggtcaccgtctcctca

SEQ ID NO: 187 - DNA, 321 bp, Artificial Sequence
  Synthetic: 19H8 (VL1) nucleotide sequence
gccatccagttgacccagtctccatcctccctgtctgcatctgtaggagacagagtcaccatcacttgccgggcaagtcagggcattagcagtgctttagcctggtatcagcagaaaccagggaaagctcctaagttcctgatctatgatgcctccagtttggaaagtggggtcccatcaaggttcagcggcagtggatctgggacagatttcactctcaccatcagcagcctgcagcctgaagattttgcaacttattactgtcaacagtttaatagttaccctcagacgttcggccaagggaccaaggtggaaatcaaa

SEQ ID NO: 188 - DNA, 321 bp, Artificial Sequence
  Synthetic: 19H8 (VL2) nucleotide sequence
gaaattgtgttgacacagtctccagccaccctgtctttgtctccaggggaaagagccaccctctcctgcagggccagtcagagtgttagcagctacttagcctggtaccaacagaaacctggccaggctcccaggctcctcatctatgatgcatccaacagggccactggcatcccagccaggttcagtggcagtgggtctgggacagacttcactctcaccatcagcagcctagagcctgaagattttgcagtttattactgtcagcagcgtagcaactggccgctcactttcggcggagggaccaaggtggagatcaaa

SEQ ID NO: 189 - DNA, 1350 bp, Artificial Sequence
  Synthetic: 19H8 (full length wild-type heavy chain) nucleotide sequence
caggtgcagctggtggagtctgggggaggcgtggtccagcctgggaggtccctgagactctcctgtgcagcgtctggattcaccttcagtaactatggcatgcactgggtccgccaggctccaggcaaggggctggagtggatggcagttatatggtatggtggaagtaataaattctatgcagactccgtgaagggccgattcaccatctccagagacaattccaagaactcgctgtctctgcaaatgaacagcctgagagccgaggacacggctgtgtattactgtgcgagagggggggctatggttcggggagtctactactacggtatggacgtctggggccaagggaccacggtcaccgtctcctcagcctccaccaagggcccatcggtcttccccctggcgccctgctccaggagcacctccgagagcacagcggccctgggctgcctggtcaaggactacttccccgaaccggtgacggtgtcgtggaactcaggcgctctgaccagcggcgtgcacaccttcccagctgtcctacagtcctcaggactctactccctcagcagcgtggtgaccgtgccctccagcaacttcggcacccagacctacacctgcaacgtagatcacaagcccagcaacaccaaggtggacaagacagttgagcgcaaatgttgtgtcgagtgcccaccgtgcccagcaccacctgtggcaggaccgtcagtcttcctcttccccccaaaacccaaggacaccctcatgatctcccggacccctgaggtcacgtgcgtggtggtggacgtgagccacgaagaccccgaggtccagttcaactggtacgtggacggcgtggaggtgcataatgccaagacaaagccacgggaggagcagttcaacagcacgttccgtgtggtcagcgtcctcaccgttgtgcaccaggactggctgaacggcaaggagtacaagtgcaaggtctccaacaaaggcctcccagcccccatcgagaaaaccatctccaaaaccaaagggcagccccgagaaccacaggtgtacaccctgcccccatcccgggaggagatgaccaagaaccaggtcagcctgacctgcctggtcaaaggcttctaccccagcgacatcgccgtggagtgggagagcaatgggcagccggagaacaactacaagaccacacctcccatgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 190 - DNA, 642 bp, Artificial Sequence
  Synthetic: 19H8 L1 (full length wild-type light chain) nucleotide sequence
gccatccagttgacccagtctccatcctccctgtctgcatctgtaggagacagagtcaccatcacttgccgggcaagtcagggcattagcagtgctttagcctggtatcagcagaaaccagggaaagctcctaagttcctgatctatgatgcctccagtttggaaagtggggtcccatcaaggttcagcggcagtggatctgggacagatttcactctcaccatcagcagcctgcagcctgaagattttgcaacttattactgtcaacagtttaatagttaccctcagacgttcggccaagggaccaaggtggaaatcaaacgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 191 - DNA, 642 bp, Artificial Sequence
  Synthetic: 19H8 L2 (full length wild-type light chain) nucleotide sequence
gaaattgtgttgacacagtctccagccaccctgtctttgtctccaggggaaagagccaccctctcctgcagggccagtcagagtgttagcagctacttagcctggtaccaacagaaacctggccaggctcccaggctcctcatctatgatgcatccaacagggccactggcatcccagccaggttcagtggcagtgggtctgggacagacttcactctcaccatcagcagcctagagcctgaagattttgcagtttattactgtcagcagcgtagcaactggccgctcactttcggcggagggaccaaggtggagatcaaacgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 192 - protein, 98 aa, Artificial Sequence
  Synthetic: VH 3-33 (28F3, 18E10, 19D3, 2G6, 8A6, 19H8)
QVQLVESGGGVVQPGRSLRLSCAASGFTFSSYGMHWVRQAPGKGLEWVAVIWYDGSNKYYADSVKGRFTISRDNSKNTLYLQMNSLRAEDTAVYYCAR

SEQ ID NO: 193 - protein, 4 aa, Artificial Sequence
  Synthetic: VH 3-10 (28F3, 8A6)
MVRG

SEQ ID NO: 194 - protein, 4 aa, Artificial Sequence
  Synthetic: VH 3-10 (9G7)
YYYG

SEQ ID NO: 195 - protein, 3 aa, Artificial Sequence
  Synthetic: VH 3-10 (19H8)
YYY

SEQ ID NO: 196 - protein, 18 aa, Artificial Sequence
  Synthetic: VH JH6 (28F3, 19H8)
YYYGMDVWGQGTTVTVSS

SEQ ID NO: 197 - protein, 17 aa, Artificial Sequence
  Synthetic: VH JH6 (18E10, 2G6, 8A6)
YYGMDVWGQGTTVTVSS

SEQ ID NO: 198 - protein, 20 aa, Artificial Sequence
  Synthetic: VH JH6 (19D3, 9G7)
YYYYYGMDVWGQGTTVTVSS

SEQ ID NO: 199 - protein, 4 aa, Artificial Sequence
  Synthetic: VH 6-19 (18E10)
IAVA

SEQ ID NO: 200 - protein, 2 aa, Artificial Sequence
  Synthetic: VH 3-16 (19D3)
DY

SEQ ID NO: 201 - protein, 97 aa, Artificial Sequence
  Synthetic: VH 4-34 (3C3, 14E3)
QVQLQQWGAGLLKPSETLSLTCAVYGGSFSGYYWSWIRQPPGKGLEWIGEINHSGSTNYNPSLKSRVTISVDTSKNQFSLKLSSVTAADTAVYYCAR

SEQ ID NO: 202 - protein, 16 aa, Artificial Sequence
  Synthetic: VH JH3 (3C3, 14E3)
DAFDIWGQGTMVTVSS

SEQ ID NO: 203 - protein, 100 aa, Artificial Sequence
  Synthetic: VH 3-15 (9G7)
EVQLVESGGGLVKPGGSLRLSCAASGFTFSNAWMSWVRQAPGKGLEWVGRIKSKTDGGTTDYAAPVKGRFTISRDDSKNTLYLQMNSLKTEDTAVYYCTT

SEQ ID NO: 204 - protein, 94 aa, Artificial Sequence
  Synthetic: VL L18 (28F3, 8A6, 19H8VK1)
AIQLTQSPSSLSASVGDRVTITCRASQGISSALAWYQQKPGKAPKLLIYDASSLESGVPSRFSGSGSGTDFTLTISSLQPEDFATYYCQQFNNY

SEQ ID NO: 205 - protein, 12 aa, Artificial Sequence
  Synthetic: VL JK2 (28F3, 18E10, 19D3, 3C3VK1, 8A6, 2G6)
YTFGQGTKLEIK

SEQ ID NO: 206 - protein, 11 aa, Artificial Sequence
  Synthetic: VL JK2 (3C3VK2)
TFGQGTKLEIK

SEQ ID NO: 207 - protein, 94 aa, Artificial Sequence
  Synthetic: VL L15 (18E10, 19D3, 3C3VK1, 2G6, 14E3)
DIQMTQSPSSLSASVGDRVTITCRASQGISSWLAWYQQKPEKAPKSLIYAASSLQSGVPSRFSGSGSGTDFTLTISSLQPEDFATYYCQQYNSY

SEQ ID NO: 208 - protein, 94 aa, Artificial Sequence
  Synthetic: VL L20 (3C3VK2)
EIVLTQSPATLSLSPGERATLSCRASQGVSSYLAWYQQKPGQAPRLLIYDASNRATGIPARFSGSGPGTDFTLTISSLEPEDFAVYYCQQRSNW

SEQ ID NO: 209 - protein, 95 aa, Artificial Sequence
  Synthetic: VL A27 (9G7VK1, 9G7VK2)
EIVLTQSPGTLSLSPGERATLSCRASQSVSSSYLAWYQQKPGQAPRLLIYGASSRATGIPDRFSGSGSGTDFTLTISRLEPEDFAVYYCQQYGSS

SEQ ID NO: 210 - protein, 12 aa, Artificial Sequence
  Synthetic: VL JK1 (9G7VK1)
WTFGQGTKVEIK

SEQ ID NO: 211 - protein, 11 aa, Artificial Sequence
  Synthetic: VL JK1 (14E3, 19H8VK1)
TFGQGTKVEIK

SEQ ID NO: 212 - protein, 12 aa, Artificial Sequence
  Synthetic: VL JK5 (9G7VK2)
ITFGQGTRLEIK

SEQ ID NO: 213 - protein, 94 aa, Artificial Sequence
  Synthetic: VL L6 (19H8VK2)
EIVLTQSPATLSLSPGERATLSCRASQSVSSYLAWYQQKPGQAPRLLIYDASNRATGIPARFSGSGSGTDFTLTISSLEPEDFAVYYCQQRSNW

SEQ ID NO: 214 - protein, 12 aa, Artificial Sequence
  Synthetic: VL JK4 (19H8VK2)
LTFGGGTKVEIK

SEQ ID NO: 215 - protein, 39 aa, Artificial Sequence
  Synthetic: GITR epitope
QRPTGGPGCGPGRLLLGTGTDARCCRVHTTRCCRDYPGE

SEQ ID NO: 216 - protein, 20 aa, Artificial Sequence
  Synthetic: GITR epitope
QRPTGGPGCGPGRLLLGTGT

SEQ ID NO: 217 - protein, 18 aa, Artificial Sequence
  Synthetic: GITR epitope (region 1)
PTGGPGCGPGRLLLGTGT

SEQ ID NO: 218 - protein, 8 aa, Artificial Sequence
  Synthetic: GITR epitope (region 2)
CRDYPGEE

SEQ ID NO: 219 - protein, 5 aa, Artificial Sequence
  Synthetic: Peptide linker
PVGVV

SEQ ID NO: 220 - protein, 5 aa, Artificial Sequence
  Synthetic: Heavy chain C-terminus
LSPGK

SEQ ID NO: 221 - protein, 325 aa, Artificial Sequence
  Synthetic: G2 constant region
ASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPG

SEQ ID NO: 222 - protein, 325 aa, Artificial Sequence
  Synthetic: G2(C219S) constant region
ASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKSCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPG

SEQ ID NO: 223 - protein, 326 aa, Artificial Sequence
  Synthetic: G2.g1 modified constant region
ASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 224 - protein, 325 aa, Artificial Sequence
  Synthetic: G2.g1.1 modified constant region
ASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPSSIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 225 - protein, 326 aa, Artificial Sequence
  Synthetic: G2(C219S).g1 modified constant region
ASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKSCVECPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 226 - protein, 325 aa, Artificial Sequence
  Synthetic: G2(C219S).g1.1 modified constant region
ASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKSCVECPPCPAPPVAGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPSSIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 227 - protein, 449 aa, Artificial Sequence
  Synthetic: 28F3 (VH + G2(C219S)) or; 28F3-IgG2-C219S
QVQLVESGGGVVQPGRSLRLSCAASGFTFSSYGMHWVRQAPGKGLEWVAVIWYEGSNKYYADSVKGRFTISRDNSKNTLYLQMNSLRAEDTAVYYCARGGSMVRGDYYYGMDVWGQGTTVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKSCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPG

SEQ ID NO: 228 - protein, 450 aa, Artificial Sequence
  Synthetic: 28F3 (VH + G2.g1) or; 28F3-IgG2-IgG1
QVQLVESGGGVVQPGRSLRLSCAASGFTFSSYGMHWVRQAPGKGLEWVAVIWYEGSNKYYADSVKGRFTISRDNSKNTLYLQMNSLRAEDTAVYYCARGGSMVRGDYYYGMDVWGQGTTVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 229 - protein, 449 aa, Artificial Sequence
  Synthetic: 28F3 (VH + G2.g1.1) or; 28F3-IgG2-IgG1.1
QVQLVESGGGVVQPGRSLRLSCAASGFTFSSYGMHWVRQAPGKGLEWVAVIWYEGSNKYYADSVKGRFTISRDNSKNTLYLQMNSLRAEDTAVYYCARGGSMVRGDYYYGMDVWGQGTTVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPSSIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 230 - protein, 450 aa, Artificial Sequence
  Synthetic: 28F3 (VH + G2(C219S).g1) or ; 28F3-IgG2-C219S-IgG1
QVQLVESGGGVVQPGRSLRLSCAASGFTFSSYGMHWVRQAPGKGLEWVAVIWYEGSNKYYADSVKGRFTISRDNSKNTLYLQMNSLRAEDTAVYYCARGGSMVRGDYYYGMDVWGQGTTVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKSCVECPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 231 - protein, 449 aa, Artificial Sequence
  Synthetic: 28F3 (VH + G2(C219S).g1.1) or; 28F3-IgG2-C219S-IgG1.1
QVQLVESGGGVVQPGRSLRLSCAASGFTFSSYGMHWVRQAPGKGLEWVAVIWYEGSNKYYADSVKGRFTISRDNSKNTLYLQMNSLRAEDTAVYYCARGGSMVRGDYYYGMDVWGQGTTVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKSCVECPPCPAPPVAGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPSSIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 232 - protein, 448 aa, Artificial Sequence
  Synthetic: 19D3 (VH + G2(C219S)) or; 19D3-IgG2-C219S
QVQLVESGGGVVQPGRSLRLSCAASGFTFSSYGFHWVRQAPGKGLEWVAVIWYAGSNKFYADSVKGRFTISRDNSKNTLYLQMNSLRAEDTAVYYCARGGQLDYYYYYVMDVWGQGTTVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKSCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPG

SEQ ID NO: 233 - protein, 449 aa, Artificial Sequence
  Synthetic: 19D3 (VH + G2.g1) or; 19D3-IgG2-IgG1
QVQLVESGGGVVQPGRSLRLSCAASGFTFSSYGFHWVRQAPGKGLEWVAVIWYAGSNKFYADSVKGRFTISRDNSKNTLYLQMNSLRAEDTAVYYCARGGQLDYYYYYVMDVWGQGTTVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 234 - protein, 448 aa, Artificial Sequence
  Synthetic: 19D3 (VH + G2.g1.1) or; 19D3-IgG2-IgG1.1
QVQLVESGGGVVQPGRSLRLSCAASGFTFSSYGFHWVRQAPGKGLEWVAVIWYAGSNKFYADSVKGRFTISRDNSKNTLYLQMNSLRAEDTAVYYCARGGQLDYYYYYVMDVWGQGTTVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPSSIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 235 - protein, 449 aa, Artificial Sequence
  Synthetic: 19D3 (VH + G2(C219S).g1) or ; 19D3-IgG2-C219S-IgG1
QVQLVESGGGVVQPGRSLRLSCAASGFTFSSYGFHWVRQAPGKGLEWVAVIWYAGSNKFYADSVKGRFTISRDNSKNTLYLQMNSLRAEDTAVYYCARGGQLDYYYYYVMDVWGQGTTVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKSCVECPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 236 - protein, 448 aa, Artificial Sequence
  Synthetic: 19D3 (VH + G2(C219S).g1.1) or; 19D3-IgG2-C219S-IgG1.1
QVQLVESGGGVVQPGRSLRLSCAASGFTFSSYGFHWVRQAPGKGLEWVAVIWYAGSNKFYADSVKGRFTISRDNSKNTLYLQMNSLRAEDTAVYYCARGGQLDYYYYYVMDVWGQGTTVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKSCVECPPCPAPPVAGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPSSIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 237 - protein, 448 aa, Artificial Sequence
  Synthetic: 18E10 (VH + G2(C219S)) or; 18E10-IgG2-C219S
QVQLVESGGGVVQPGRSLRLSCAASGFTFSSYGMHWVRQAPGKGLEWVAVIWYAGSNKYYADSVKGRFTISRDNSKNTLYLQMNSLRAEDTAVYYCARGGRIAVAFYYSMDVWGQGTTVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKSCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPG

SEQ ID NO: 238 - protein, 449 aa, Artificial Sequence
  Synthetic: 18E10 (VH + G2.g1) or; 18E10-IgG2-IgG1
QVQLVESGGGVVQPGRSLRLSCAASGFTFSSYGMHWVRQAPGKGLEWVAVIWYAGSNKYYADSVKGRFTISRDNSKNTLYLQMNSLRAEDTAVYYCARGGRIAVAFYYSMDVWGQGTTVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 239 - protein, 448 aa, Artificial Sequence
  Synthetic: 18E10 (VH + G2.g1.1) or; 18E10-IgG2-IgG1.1
QVQLVESGGGVVQPGRSLRLSCAASGFTFSSYGMHWVRQAPGKGLEWVAVIWYAGSNKYYADSVKGRFTISRDNSKNTLYLQMNSLRAEDTAVYYCARGGRIAVAFYYSMDVWGQGTTVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPSSIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 240 - protein, 449 aa, Artificial Sequence
  Synthetic: 18E10 (VH + G2(C219S).g1) or ; 18E10-IgG2-C219S-IgG1
QVQLVESGGGVVQPGRSLRLSCAASGFTFSSYGMHWVRQAPGKGLEWVAVIWYAGSNKYYADSVKGRFTISRDNSKNTLYLQMNSLRAEDTAVYYCARGGRIAVAFYYSMDVWGQGTTVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKSCVECPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 241 - protein, 448 aa, Artificial Sequence
  Synthetic: 18E10 (VH + G2(C219S).g1.1) or; 18E10-IgG2-C219S-IgG1.1
QVQLVESGGGVVQPGRSLRLSCAASGFTFSSYGMHWVRQAPGKGLEWVAVIWYAGSNKYYADSVKGRFTISRDNSKNTLYLQMNSLRAEDTAVYYCARGGRIAVAFYYSMDVWGQGTTVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKSCVECPPCPAPPVAGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPSSIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 242 - protein, 442 aa, Artificial Sequence
  Synthetic: 3C3 (VH + G2) or ; 3C3-IgG2
QVQLQQWGAGLLKPSETLSLTCAVYGGSFSGYYWTWIRQPPGKGLEWIGKINHSGNTNYNPSLKSRVTISVDTSKNQFSLKLSSVTAADTAVYYCARLGAFDAFDIWGQGTMVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPG

SEQ ID NO: 243 - protein, 442 aa, Artificial Sequence
  Synthetic: 3C3 (VH + G2(C219S)) or; 3C3-IgG2-C219S
QVQLQQWGAGLLKPSETLSLTCAVYGGSFSGYYWTWIRQPPGKGLEWIGKINHSGNTNYNPSLKSRVTISVDTSKNQFSLKLSSVTAADTAVYYCARLGAFDAFDIWGQGTMVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKSCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPG

SEQ ID NO: 244 - protein, 443 aa, Artificial Sequence
  Synthetic: 3C3 (VH + G2.g1) or; 3C3-IgG2-IgG1
QVQLQQWGAGLLKPSETLSLTCAVYGGSFSGYYWTWIRQPPGKGLEWIGKINHSGNTNYNPSLKSRVTISVDTSKNQFSLKLSSVTAADTAVYYCARLGAFDAFDIWGQGTMVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 245 - protein, 442 aa, Artificial Sequence
  Synthetic: 3C3 (VH + G2.g1.1) or; 3C3-IgG2-IgG1.1
QVQLQQWGAGLLKPSETLSLTCAVYGGSFSGYYWTWIRQPPGKGLEWIGKINHSGNTNYNPSLKSRVTISVDTSKNQFSLKLSSVTAADTAVYYCARLGAFDAFDIWGQGTMVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPSSIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 246 - protein, 443 aa, Artificial Sequence
  Synthetic: 3C3 (VH + G2(C219S).g1) or ; 3C3-IgG2-C219S-IgG1
QVQLQQWGAGLLKPSETLSLTCAVYGGSFSGYYWTWIRQPPGKGLEWIGKINHSGNTNYNPSLKSRVTISVDTSKNQFSLKLSSVTAADTAVYYCARLGAFDAFDIWGQGTMVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKSCVECPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 247 - protein, 442 aa, Artificial Sequence
  Synthetic: 3C3 (VH + G2(C219S).g1.1) or; 3C3-IgG2-C219S-IgG1.1
QVQLQQWGAGLLKPSETLSLTCAVYGGSFSGYYWTWIRQPPGKGLEWIGKINHSGNTNYNPSLKSRVTISVDTSKNQFSLKLSSVTAADTAVYYCARLGAFDAFDIWGQGTMVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKSCVECPPCPAPPVAGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPSSIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 248 - protein, 449 aa, Artificial Sequence
  Synthetic: 2G6 (VH + G2) or ; 2G6-IgG2
QVQLVESGGGVVQPGGSLRLSCAASGFILSDYGMHWVRQAPGKGLEWVTVIWYDGSNKFYVDSVKGRFTISRDNSKNTLYLQMNSLRVEDTAVYYCARGGRLATGHFYYVMDVWGQGTTVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPG

SEQ ID NO: 249 - protein, 449 aa, Artificial Sequence
  Synthetic: 2G6 (VH + G2(C219S)) or; 2G6-IgG2-C219S
QVQLVESGGGVVQPGGSLRLSCAASGFILSDYGMHWVRQAPGKGLEWVTVIWYDGSNKFYVDSVKGRFTISRDNSKNTLYLQMNSLRVEDTAVYYCARGGRLATGHFYYVMDVWGQGTTVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKSCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPG

SEQ ID NO: 250 - protein, 450 aa, Artificial Sequence
  Synthetic: 2G6 (VH + G2.g1) or; 2G6-IgG2-IgG1
QVQLVESGGGVVQPGGSLRLSCAASGFILSDYGMHWVRQAPGKGLEWVTVIWYDGSNKFYVDSVKGRFTISRDNSKNTLYLQMNSLRVEDTAVYYCARGGRLATGHFYYVMDVWGQGTTVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 251 - protein, 449 aa, Artificial Sequence
  Synthetic: 2G6  (VH + G2.g1.1) or; 2G6-IgG2-IgG1.1
QVQLVESGGGVVQPGGSLRLSCAASGFILSDYGMHWVRQAPGKGLEWVTVIWYDGSNKFYVDSVKGRFTISRDNSKNTLYLQMNSLRVEDTAVYYCARGGRLATGHFYYVMDVWGQGTTVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPSSIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 252 - protein, 450 aa, Artificial Sequence
  Synthetic: 2G6 (VH + G2(C219S).g1) or ; 2G6-IgG2-C219S-IgG1
QVQLVESGGGVVQPGGSLRLSCAASGFILSDYGMHWVRQAPGKGLEWVTVIWYDGSNKFYVDSVKGRFTISRDNSKNTLYLQMNSLRVEDTAVYYCARGGRLATGHFYYVMDVWGQGTTVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKSCVECPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 253 - protein, 449 aa, Artificial Sequence
  Synthetic: 2G6 (VH + G2(C219S).g1.1) or; 2G6-IgG2-C219S-IgG1.1
QVQLVESGGGVVQPGGSLRLSCAASGFILSDYGMHWVRQAPGKGLEWVTVIWYDGSNKFYVDSVKGRFTISRDNSKNTLYLQMNSLRVEDTAVYYCARGGRLATGHFYYVMDVWGQGTTVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKSCVECPPCPAPPVAGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPSSIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 254 - protein, 449 aa, Artificial Sequence
  Synthetic: 8A6 (VH + G2(C219S)) or; 8A6-IgG2-C219S
QVQLVESGGGVVQPGRSLRLSCTASGFTFSSYGMQWVRQAPGKGLEWVAVIWYEGSNKYYADSVKGRFTISRENSKNTLYLQMNSLRAEDTAVYYCARGGLMVRGLFYYGMDVWGQGTTVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKSCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPG

SEQ ID NO: 255 - protein, 450 aa, Artificial Sequence
  Synthetic: 8A6 (VH + G2.g1) or; 8A6 -IgG2-IgG1
QVQLVESGGGVVQPGRSLRLSCTASGFTFSSYGMQWVRQAPGKGLEWVAVIWYEGSNKYYADSVKGRFTISRENSKNTLYLQMNSLRAEDTAVYYCARGGLMVRGLFYYGMDVWGQGTTVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 256 - protein, 449 aa, Artificial Sequence
  Synthetic: 8A6 (VH + G2.g1.1) or; 8A6 -IgG2-IgG1.1
QVQLVESGGGVVQPGRSLRLSCTASGFTFSSYGMQWVRQAPGKGLEWVAVIWYEGSNKYYADSVKGRFTISRENSKNTLYLQMNSLRAEDTAVYYCARGGLMVRGLFYYGMDVWGQGTTVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPSSIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 257 - protein, 450 aa, Artificial Sequence
  Synthetic: 8A6 (VH + G2(C219S).g1) or ; 8A6-IgG2-C219S-IgG1
QVQLVESGGGVVQPGRSLRLSCTASGFTFSSYGMQWVRQAPGKGLEWVAVIWYEGSNKYYADSVKGRFTISRENSKNTLYLQMNSLRAEDTAVYYCARGGLMVRGLFYYGMDVWGQGTTVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKSCVECPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 258 - protein, 449 aa, Artificial Sequence
  Synthetic: 8A6 (VH + G2(C219S).g1.1) or; 8A6-IgG2-C219S-IgG1.1
QVQLVESGGGVVQPGRSLRLSCTASGFTFSSYGMQWVRQAPGKGLEWVAVIWYEGSNKYYADSVKGRFTISRENSKNTLYLQMNSLRAEDTAVYYCARGGLMVRGLFYYGMDVWGQGTTVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKSCVECPPCPAPPVAGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPSSIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 259 - protein, 450 aa, Artificial Sequence
  Synthetic: 9G7 (VH + G2) or ; 9G7-IgG2
EVQLVESGGGLVKPGGSLRLSCAASGFTFSTVWMSWVRQAPGKGLEWVGRIKSKTDGGTTDYAAPVKGRFTISRDDSKNTLYLQMNSLHTEDTAVYYCTTGQLIPYSYYYGMDVWGQGTSVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPG

SEQ ID NO: 260 - protein, 450 aa, Artificial Sequence
  Synthetic: 9G7 (VH + G2(C219S)) or; 9G7-IgG2-C219S
EVQLVESGGGLVKPGGSLRLSCAASGFTFSTVWMSWVRQAPGKGLEWVGRIKSKTDGGTTDYAAPVKGRFTISRDDSKNTLYLQMNSLHTEDTAVYYCTTGQLIPYSYYYGMDVWGQGTSVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKSCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPG

SEQ ID NO: 261 - protein, 451 aa, Artificial Sequence
  Synthetic: 9G7 (VH + G2.g1) or; 9G7-IgG2-IgG1
EVQLVESGGGLVKPGGSLRLSCAASGFTFSTVWMSWVRQAPGKGLEWVGRIKSKTDGGTTDYAAPVKGRFTISRDDSKNTLYLQMNSLHTEDTAVYYCTTGQLIPYSYYYGMDVWGQGTSVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 262 - protein, 450 aa, Artificial Sequence
  Synthetic: 9G7 (VH + G2.g1.1) or; 9G7-IgG2-IgG1.1
EVQLVESGGGLVKPGGSLRLSCAASGFTFSTVWMSWVRQAPGKGLEWVGRIKSKTDGGTTDYAAPVKGRFTISRDDSKNTLYLQMNSLHTEDTAVYYCTTGQLIPYSYYYGMDVWGQGTSVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPSSIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 263 - protein, 451 aa, Artificial Sequence
  Synthetic: 9G7 (VH + G2(C219S).g1) or ; 9G7-IgG2-C219S-IgG1
EVQLVESGGGLVKPGGSLRLSCAASGFTFSTVWMSWVRQAPGKGLEWVGRIKSKTDGGTTDYAAPVKGRFTISRDDSKNTLYLQMNSLHTEDTAVYYCTTGQLIPYSYYYGMDVWGQGTSVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKSCVECPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 264 - protein, 450 aa, Artificial Sequence
  Synthetic: 9G7 (VH + G2(C219S).g1.1) or; 9G7-IgG2-C219S-IgG1.1
EVQLVESGGGLVKPGGSLRLSCAASGFTFSTVWMSWVRQAPGKGLEWVGRIKSKTDGGTTDYAAPVKGRFTISRDDSKNTLYLQMNSLHTEDTAVYYCTTGQLIPYSYYYGMDVWGQGTSVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKSCVECPPCPAPPVAGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPSSIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 265 - protein, 442 aa, Artificial Sequence
  Synthetic: 14E3 (VH + G2) or ; 14E3-IgG2
QVQLQQWGAGLLKPSETLSLTCAVYGGSFSGYYWSWIRQPPGKGLEWIGEINHSGNTYYNPSLKSRVTISVDTSKNQLSLKLSSVTAADTAVYYCARFGSNDAFDIWGQGTMVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPG

SEQ ID NO: 266 - protein, 442 aa, Artificial Sequence
  Synthetic: 14E3 (VH + G2(C219S)) or; 14E3-IgG2-C219S
QVQLQQWGAGLLKPSETLSLTCAVYGGSFSGYYWSWIRQPPGKGLEWIGEINHSGNTYYNPSLKSRVTISVDTSKNQLSLKLSSVTAADTAVYYCARFGSNDAFDIWGQGTMVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKSCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPG

SEQ ID NO: 267 - protein, 443 aa, Artificial Sequence
  Synthetic: 14E3 (VH + G2.g1) or; 14E3-IgG2-IgG1
QVQLQQWGAGLLKPSETLSLTCAVYGGSFSGYYWSWIRQPPGKGLEWIGEINHSGNTYYNPSLKSRVTISVDTSKNQLSLKLSSVTAADTAVYYCARFGSNDAFDIWGQGTMVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 268 - protein, 442 aa, Artificial Sequence
  Synthetic: 14E3 (VH + G2.g1.1) or; 14E3-IgG2-IgG1.1
QVQLQQWGAGLLKPSETLSLTCAVYGGSFSGYYWSWIRQPPGKGLEWIGEINHSGNTYYNPSLKSRVTISVDTSKNQLSLKLSSVTAADTAVYYCARFGSNDAFDIWGQGTMVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPSSIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 269 - protein, 443 aa, Artificial Sequence
  Synthetic: 14E3 (VH + G2(C219S).g1) or ; 14E3-IgG2-C219S-IgG1
QVQLQQWGAGLLKPSETLSLTCAVYGGSFSGYYWSWIRQPPGKGLEWIGEINHSGNTYYNPSLKSRVTISVDTSKNQLSLKLSSVTAADTAVYYCARFGSNDAFDIWGQGTMVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKSCVECPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 270 - protein, 442 aa, Artificial Sequence
  Synthetic: 14E3 (VH + G2(C219S).g1.1) or; 14E3-IgG2-C219S-IgG1.1
QVQLQQWGAGLLKPSETLSLTCAVYGGSFSGYYWSWIRQPPGKGLEWIGEINHSGNTYYNPSLKSRVTISVDTSKNQLSLKLSSVTAADTAVYYCARFGSNDAFDIWGQGTMVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKSCVECPPCPAPPVAGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPSSIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 271 - protein, 449 aa, Artificial Sequence
  Synthetic: 19H8 (VH + G2(C219S)) or; 19H8-IgG2-C219S
QVQLVESGGGVVQPGRSLRLSCAASGFTFSNYGMHWVRQAPGKGLEWMAVIWYGGSNKFYADSVKGRFTISRDNSKNSLSLQMNSLRAEDTAVYYCARGGAMVRGVYYYGMDVWGQGTTVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKSCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPG

SEQ ID NO: 272 - protein, 450 aa, Artificial Sequence
  Synthetic: 19H8 (VH + G2.g1) or; 19H8-IgG2-IgG1
QVQLVESGGGVVQPGRSLRLSCAASGFTFSNYGMHWVRQAPGKGLEWMAVIWYGGSNKFYADSVKGRFTISRDNSKNSLSLQMNSLRAEDTAVYYCARGGAMVRGVYYYGMDVWGQGTTVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 273 - protein, 449 aa, Artificial Sequence
  Synthetic: 19H8 (VH + G2.g1.1) or; 19H8-IgG2-IgG1.1
QVQLVESGGGVVQPGRSLRLSCAASGFTFSNYGMHWVRQAPGKGLEWMAVIWYGGSNKFYADSVKGRFTISRDNSKNSLSLQMNSLRAEDTAVYYCARGGAMVRGVYYYGMDVWGQGTTVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPSSIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 274 - protein, 450 aa, Artificial Sequence
  Synthetic: 19H8 (VH + G2(C219S).g1) or ; 19H8-IgG2-C219S-IgG1
QVQLVESGGGVVQPGRSLRLSCAASGFTFSNYGMHWVRQAPGKGLEWMAVIWYGGSNKFYADSVKGRFTISRDNSKNSLSLQMNSLRAEDTAVYYCARGGAMVRGVYYYGMDVWGQGTTVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKSCVECPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 275 - protein, 449 aa, Artificial Sequence
  Synthetic: 19H8 (VH + G2(C219S).g1.1) or; 19H8-IgG2-C219S-IgG1.1
QVQLVESGGGVVQPGRSLRLSCAASGFTFSNYGMHWVRQAPGKGLEWMAVIWYGGSNKFYADSVKGRFTISRDNSKNSLSLQMNSLRAEDTAVYYCARGGAMVRGVYYYGMDVWGQGTTVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKSCVECPPCPAPPVAGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPSSIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 276 - protein, 4 aa, Artificial Sequence
  Synthetic: Heavy chain C-terminus
LSPG

SEQ ID NO: 277 - skipped

SEQ ID NO: 278 - protein, 98 aa, Homo sapiens
  misc_feature (1)..(98): Wildtype human IgG1 CH1
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKV

SEQ ID NO: 279 - protein, 98 aa, Homo sapiens
  misc_feature (1)..(98): Wildtype human IgG2 CH1
ASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTV

SEQ ID NO: 280 - protein, 103 aa, Homo sapiens
  misc_feature (1)..(103): Wildtype human IgG1 CH2
PSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAK

SEQ ID NO: 281 - protein, 103 aa, Homo sapiens
  misc_feature (1)..(103): Human IgG1 CH2 with A330S/P331S
PSVFLFPPKPKDTLMISRTPEVTCVVVDVSHEDPEVKFNWYVDGVEVHNAKTKPREEQYNSTYRVVSVLTVLHQDWLNGKEYKCKVSNKALPSSIEKTISKAK

SEQ ID NO: 282 - protein, 106 aa, Homo sapiens
  misc_feature (1)..(106): Wildtype human IgG1 CH3
GQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 283 - protein, 326 aa, Artificial Sequence
  Synthetic: IgG1-IgG2-IgG1f
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVERKCCVECPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 284 - protein, 325 aa, Artificial Sequence
  Synthetic: IgG1-IgG2CS-IgG1f
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVERKSCVECPPCPAPPVAGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 285 - protein, 325 aa, Artificial Sequence
  Synthetic: IgG1-IgG2-IgG1.1f
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVERKCCVECPPCPAPPVAGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPSSIEKTISKAKGQPREPQVYTLPPSRREMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 286 - protein, 325 aa, Artificial Sequence
  Synthetic: IgG1-IgG2CS-IgG1.1f
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVERKSCVECPPCPAPPVAGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPSSIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 287 - protein, 325 aa, Artificial Sequence
  Synthetic: IgG1-IgG2-1gG1f2
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVERKCCVECPPCPAPPVAGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 288 - protein, 325 aa, Artificial Sequence; identical to SEQ ID NO: 284
  Synthetic: IgG1-IgG2(C219S)-IgG1f2

SEQ ID NO: 289 - protein, 325 aa, Artificial Sequence
  Synthetic: IgG2-IgG1f2
ASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 290 - protein, 325 aa, Artificial Sequence
  Synthetic: IgG2(C219S)-IgG1f2
ASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKSCVECPPCPAPPVAGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 291 - protein, 18 aa, Homo sapiens
  misc_feature (1)..(18): WT human IgG2 hinge
ERKCCVECPPCPAPPVAG

SEQ ID NO: 292 - protein, 18 aa, Homo sapiens
  misc_feature (1)..(18): Human IgG2 hinge with C219S
ERKSCVECPPCPAPPVAG

SEQ ID NO: 293 - protein, 19 aa, Artificial Sequence
  Synthetic: IgG2/IgG1 hinge
ERKCCVECPPCPAPELLGG

SEQ ID NO: 294 - protein, 19 aa, Artificial Sequence
  Synthetic: IgG2 (C219S)/IgG1 hinge
ERKSCVECPPCPAPELLGG

SEQ ID NO: 295 - protein, 22 aa, Homo sapiens
  misc_feature (1)..(22): Wild type human IgG1 hinge
EPKSCDKTHTCPPCPAPELLGG

SEQ ID NO: 296 - protein, 22 aa, Artificial Sequence
  Synthetic: IgG1.1 Hinge (L234A/L235E/G237A)
EPKSCDKTHTCPPCPAPEAEGA

SEQ ID NO: 297 - protein, 103 aa, Homo sapiens
  misc_feature (1)..(103): Wildtype human IgG2 CH2
PSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTK

SEQ ID NO: 298 - protein, 107 aa, Homo sapiens
  misc_feature (1)..(107): Wildtype human IgG2 CH3
GQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 299 - protein, 5 aa, Artificial Sequence
  Synthetic: IgG1 C-termianl CH1 (same for IgG3 (17-15-15-15), igG3 (17-15-15), IgG3 (17-15), IgG3 (15-15-15), IgG3 (15), and IgG4
VDKRV

SEQ ID NO: 300 - protein, 5 aa, Artificial Sequence
  Synthetic: IgG2 C-termianl CH1
VDKTV

SEQ ID NO: 301 - protein, 10 aa, Artificial Sequence
  Synthetic: IgG1 upper hinge
EPKSCDKTHT

SEQ ID NO: 302 - protein, 12 aa, Artificial Sequence
  Synthetic: IgG3 (17-15-15-15) upper hinge (same for IgG3 (17-15-15) and IgG3 (17-15))
ELKTPLGDTTHT

SEQ ID NO: 303 - protein, 4 aa, Artificial Sequence
  Synthetic: IgG3 (15-15-15) upper hinge (same for IgG3(15))
EPKS

SEQ ID NO: 304 - protein, 7 aa, Artificial Sequence
  Synthetic: IgG4 upper hinge
ESKYGPP

SEQ ID NO: 305 - protein, 5 aa, Artificial Sequence
  Synthetic: IgG1 middle hinge
CPPCP

SEQ ID NO: 306 - protein, 9 aa, Artificial Sequence
  Synthetic: IgG2 middle hinge
CCVECPPCP

SEQ ID NO: 307 - protein, 50 aa, Artificial Sequence
  Synthetic: IgG3 (17-15-15-15) middle hinge
CPRCPEPKSCDTPPPCPRCPEPKSCDTPPPCPRCPEPKSCDTPPPCPRCP

SEQ ID NO: 308 - protein, 35 aa, Artificial Sequence
  Synthetic: IgG3 (17-15-15) middle hinge
CPRCPEPKSCDTPPPCPRCPEPKSCDTPPPCPRCP

SEQ ID NO: 309 - protein, 20 aa, Artificial Sequence
  Synthetic: IgG3 (17-15) middle hinge
CPRCPEPKSCDTPPPCPRCP

SEQ ID NO: 310 - protein, 41 aa, Artificial Sequence
  Synthetic: IgG3 (15-15-15) middle hinge
CDTPPPCPRCPEPKSCDTPPPCPRCPEPKSCDTPPPCPRCP

SEQ ID NO: 311 - protein, 11 aa, Artificial Sequence
  Synthetic: IgG3 (15) middle hinge
CDTPPPCPRCP

SEQ ID NO: 312 - protein, 5 aa, Artificial Sequence
  Synthetic: IgG4 middle hinge
CPSCP

SEQ ID NO: 313 - protein, 7 aa, Artificial Sequence
  Synthetic: IgG1 lower hinge (same for IgG3 (17-15-15-15), IgG3 (17-15-15), IgG3 (17-15), IgG3 (15-15-15), IgG3 (15), and IgG4)
APELLGG

SEQ ID NO: 314 - protein, 6 aa, Artificial Sequence
  Synthetic: IgG2 lower hinge
APPVAG

SEQ ID NO: 315 - protein, 19 aa, Artificial Sequence
  Synthetic: 28F3 VH signal sequence (same for 18E10, 19D3, 19H8, 6G10)
MEFGLSWVFLVALLRGVQC

SEQ ID NO: 316 - protein, 57 aa, Artificial Sequence
  Synthetic: 28F3 VH signal sequence (nucleotide sequence)
ATGGAGTTTGGGCTGAGCTGGGTTTTCCTCGTTGCTCTTTTAAGAGGTGTCCAGTGT

SEQ ID NO: 317 - protein, 22 aa, Artificial Sequence
  Synthetic: 28F3 VL signal sequence (same for 18E10, 8A6, 19H8VL1, 6G10)
MDMRVPAQLLGLLLLWLPGARC

SEQ ID NO: 318 - protein, 64 aa, Artificial Sequence
  Synthetic: 28F3 VL signal sequence (nucleotide sequence)
ATGGACATGAGGGTCCCCGCTCAGCTCCTGGGGCTTCTGCTGCTCTGGCTCCCAGGTGCCAGAT

SEQ ID NO: 319 - protein, 20 aa, Artificial Sequence
  Synthetic: 19D3 VL signal sequence
MRVLAQLLGLLLLCFPGARC

SEQ ID NO: 320 - protein, 60 aa, Artificial Sequence
  Synthetic: 19D3 VL signal sequence (nucleotide sequence)
ATGAGGGTCCTCGCTCAGCTCCTGGGGCTCCTGCTGCTCTGTTTCCCAGGTGCCAGATGT

SEQ ID NO: 321 - protein, 19 aa, Artificial Sequence
  Synthetic: 3C3 VH signal sequence (same for 14E3)
MKHLWFFLLLVAAPRWVLS

SEQ ID NO: 322 - protein, 57 aa, Artificial Sequence
  Synthetic: 3C3 VH signal sequence (nucleotide sequence)
ATGAAACACCTGTGGTTCTTCCTCCTCCTGGTGGCAGCTCCCAGATGGGTCCTGTCC

SEQ ID NO: 323 - protein, 22 aa, Artificial Sequence
  Synthetic: 3C3 VL signal sequence (same for 14E3)
MDMRVLAQLLGLLLLCFPGARC

SEQ ID NO: 324 - protein, 66 aa, Artificial Sequence
  Synthetic: 3C3 VL signal sequence (nucleotide sequence)
ATGGACATGAGGGTCCTCGCTCAGCTCCTGGGGCTCCTGCTGCTCTGTTTCCCAGGTGCCAGATGT

SEQ ID NO: 325 - protein, 20 aa, Artificial Sequence
  Synthetic: 3C3 VL2 signal sequence (same for 19H8 VL2)
MEAPAQLLFLLLLWLPDTTG

SEQ ID NO: 326 - protein, 60 aa, Artificial Sequence
  Synthetic: 3C3 VL2 signal sequence (nucleotide sequence)
ATGGAAGCCCCAGCGCAGCTTCTCTTCCTCCTGCTACTCTGGCTCCCAGATACCACCGGA

SEQ ID NO: 327 - protein, 19 aa, Artificial Sequence
  Synthetic: 8A6 VH signal sequence
MEFGLNWVFLVALLRGVQC

SEQ ID NO: 328 - protein, 57 aa, Artificial Sequence
  Synthetic: 8A6 VH signal sequence (nucleotide sequence)
ATGGAGTTTGGGCTGAACTGGGTTTTCCTCGTTGCTCTTTTAAGAGGTGTCCAGTGT

SEQ ID NO: 329 - protein, 19 aa, Artificial Sequence
  Synthetic: 9G7 VH signal sequence
MEFGLSWIFLAAILKGVQC

SEQ ID NO: 330 - protein, 57 aa, Artificial Sequence
  Synthetic: 9G7 VH signal sequence (nucleotide sequence)
ATGGAGTTTGGGCTGAGCTGGATTTTCCTTGCTGCTATTTTAAAAGGTGTCCAGTGT

SEQ ID NO: 331 - protein, 20 aa, Artificial Sequence
  Synthetic: 9G7 VL1 and VL2 signal sequence
METPAQLLFLLLLWLPDTTG

SEQ ID NO: 332 - protein, 60 aa, Artificial Sequence
  Synthetic: 9G7 VL1 and VL2 signal sequence (nucleotide sequence)
ATGGAAACCCCAGCGCAGCTTCTCTTCCTCCTGCTACTCTGGCTCCCAGATACCACCGGA

SEQ ID NO: 333 - protein, 19 aa, Artificial Sequence
  Synthetic: 14E3 VH signal sequence
MKHLWFFLLLVAAPRWVLS

SEQ ID NO: 334 - protein, 57 aa, Artificial Sequence; identical to SEQ ID NO: 322
  Synthetic: 14E3 VH signal sequence (nucleotide sequence)

SEQ ID NO: 335 - protein, 124 aa, Artificial Sequence
  Synthetic: 6G10 (VH)
QVQLVESGGDVVQPGRSLRLSCAASGFTFSTYGMHWVRQAPGKGLEWVAVTWYAGSNKFYADSVKGRFTISRDNSKNTLYLQMNSLRAEDTAVYYCARGGSMVRGLYYYGMDVWGQGTTVTVSS

SEQ ID NO: 336 - protein, 107 aa, Artificial Sequence; identical to SEQ ID NO: 14
  Synthetic: 6G10 (VL)

SEQ ID NO: 337 - protein, 450 aa, Artificial Sequence
  Synthetic: 6G10 (full length wild-type heavy chain)
QVQLVESGGDVVQPGRSLRLSCAASGFTFSTYGMHWVRQAPGKGLEWVAVTWYAGSNKFYADSVKGRFTISRDNSKNTLYLQMNSLRAEDTAVYYCARGGSMVRGLYYYGMDVWGQGTTVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 338 - protein, 214 aa, Artificial Sequence; identical to SEQ ID NO: 16
  Synthetic: 6G10 (full length wild-type light chain)

SEQ ID NO: 339 - protein, 453 aa, Artificial Sequence
  Synthetic: 6G10.IgG1 (VH + IgG1)
QVQLVESGGDVVQPGRSLRLSCAASGFTFSTYGMHWVRQAPGKGLEWVAVTWYAGSNKFYADSVKGRFTISRDNSKNTLYLQMNSLRAEDTAVYYCARGGSMVRGLYYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 340 - protein, 453 aa, Artificial Sequence
  Synthetic: 6G10.IgG1.1 (VH + IgG1.1)
QVQLVESGGDVVQPGRSLRLSCAASGFTFSTYGMHWVRQAPGKGLEWVAVTWYAGSNKFYADSVKGRFTISRDNSKNTLYLQMNSLRAEDTAVYYCARGGSMVRGLYYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPSSIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 341 - protein, 214 aa, Artificial Sequence; identical to SEQ ID NO: 16
  Synthetic: 6G10.IgG1 (VL + CL)

SEQ ID NO: 342 - protein, 5 aa, Artificial Sequence
  Synthetic: 6G10 VH CDR1
TYGMH

SEQ ID NO: 343 - protein, 17 aa, Artificial Sequence
  Synthetic: 6G10 VH CDR2
VTWYAGSNKFYADSVKG

SEQ ID NO: 344 - protein, 15 aa, Artificial Sequence
  Synthetic: 6G10 VH CDR3
GGSMVRGLYYYGMDV

SEQ ID NO: 345 - protein, 11 aa, Artificial Sequence
  Synthetic: 6G10 VL CDR1
RASQGISSALA

SEQ ID NO: 346 - protein, 7 aa, Artificial Sequence
  Synthetic: 6G10 VL CDR2
DASSLES

SEQ ID NO: 347 - protein, 9 aa, Artificial Sequence
  Synthetic: 6G10 VL CDR3
QQFNSYPYT

SEQ ID NO: 348 - protein, 449 aa, Artificial Sequence
  Synthetic: 6G10 (VH + G2(C219S)) or 6G10-IgG2-C219S
QVQLVESGGDVVQPGRSLRLSCAASGFTFSTYGMHWVRQAPGKGLEWVAVTWYAGSNKFYADSVKGRFTISRDNSKNTLYLQMNSLRAEDTAVYYCARGGSMVRGLYYYGMDVWGQGTTVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKSCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPG

SEQ ID NO: 349 - protein, 450 aa, Artificial Sequence
  Synthetic: 6G10 (VH + G2.g1) or 6G10-IgG2-IgG1
QVQLVESGGDVVQPGRSLRLSCAASGFTFSTYGMHWVRQAPGKGLEWVAVTWYAGSNKFYADSVKGRFTISRDNSKNTLYLQMNSLRAEDTAVYYCARGGSMVRGLYYYGMDVWGQGTTVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 350 - protein, 449 aa, Artificial Sequence
  Synthetic: 6G10 (VH + G2.g1.1) or 6G10-IgG2-IgG1.1
QVQLVESGGDVVQPGRSLRLSCAASGFTFSTYGMHWVRQAPGKGLEWVAVTWYAGSNKFYADSVKGRFTISRDNSKNTLYLQMNSLRAEDTAVYYCARGGSMVRGLYYYGMDVWGQGTTVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPSSIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 351 - protein, 450 aa, Artificial Sequence
  Synthetic: 6G10 (VH + G2(C219S).g1) or 6G10-IgG2-C219S-IgG1
QVQLVESGGDVVQPGRSLRLSCAASGFTFSTYGMHWVRQAPGKGLEWVAVTWYAGSNKFYADSVKGRFTISRDNSKNTLYLQMNSLRAEDTAVYYCARGGSMVRGLYYYGMDVWGQGTTVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKSCVECPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 352 - protein, 449 aa, Artificial Sequence
  Synthetic: 6G10 (VH + G2(C219S).g1.1) or 6G10-IgG2-C219S-IgG1.1
QVQLVESGGDVVQPGRSLRLSCAASGFTFSTYGMHWVRQAPGKGLEWVAVTWYAGSNKFYADSVKGRFTISRDNSKNTLYLQMNSLRAEDTAVYYCARGGSMVRGLYYYGMDVWGQGTTVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKSCVECPPCPAPPVAGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPSSIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 353 - protein, 372 aa, Artificial Sequence
  Synthetic: 6G10 (VH) nucleotide sequence
CAGGTGCAGCTGGTGGAGTCTGGGGGAGACGTGGTCCAGCCTGGGAGGTCCCTGAGACTCTCCTGTGCAGCGTCTGGATTCACCTTCAGTACCTATGGCATGCACTGGGTCCGCCAGGCTCCAGGCAAGGGGCTGGAGTGGGTGGCAGTTACATGGTATGCTGGAAGTAATAAATTTTATGCAGACTCCGTGAAGGGCCGATTCACCATCTCCAGAGACAATTCCAAGAACACGCTGTATCTGCAAATGAACAGCCTGAGAGCCGAGGACACGGCTGTGTATTACTGTGCGAGAGGAGGTAGTATGGTTCGGGGACTTTATTATTACGGTATGGACGTCTGGGGCCAAGGGACCACGGTCACCGTCTCCTCA

SEQ ID NO: 354 - protein, 321 aa, Artificial Sequence
  Synthetic: 6G10 (VL) nucleotide sequence
GCCATCCAGTTGACCCAGTCTCCATCCTCCCTGTCTGCATCTGTAGGAGACAGAGTCACCATCACTTGCCGGGCAAGTCAGGGCATTAGCAGTGCTTTAGCCTGGTATCAGCAGAAACCAGGGAAAGCTCCTAAGCTCCTGATCTATGATGCCTCCAGTTTGGAAAGTGGGGTCCCATCAAGGTTCAGCGGCAGTGGATCTGGGACAGATTTCACTCTCACCATCAGCAGCCTGCAGCCTGAAGATTTTGCAACTTATTACTGTCAACAGTTTAATAGTTACCCGTACACTTTTGGCCAGGGGACCAAGCTGGAGATCAAA

SEQ ID NO: 355 - protein, 1350 aa, Artificial Sequence
  Synthetic: 6G10 (full length wild-type heavy chain) nucleotide sequence
CAGGTGCAGCTGGTGGAGTCTGGGGGAGACGTGGTCCAGCCTGGGAGGTCCCTGAGACTCTCCTGTGCAGCGTCTGGATTCACCTTCAGTACCTATGGCATGCACTGGGTCCGCCAGGCTCCAGGCAAGGGGCTGGAGTGGGTGGCAGTTACATGGTATGCTGGAAGTAATAAATTTTATGCAGACTCCGTGAAGGGCCGATTCACCATCTCCAGAGACAATTCCAAGAACACGCTGTATCTGCAAATGAACAGCCTGAGAGCCGAGGACACGGCTGTGTATTACTGTGCGAGAGGAGGTAGTATGGTTCGGGGACTTTATTATTACGGTATGGACGTCTGGGGCCAAGGGACCACGGTCACCGTCTCCTCAGCCTCCACCAAGGGCCCATCGGTCTTCCCCCTGGCGCCCTGCTCCAGGAGCACCTCCGAGAGCACAGCGGCCCTGGGCTGCCTGGTCAAGGACTACTTCCCCGAACCGGTGACGGTGTCGTGGAACTCAGGCGCTCTGACCAGCGGCGTGCACACCTTCCCAGCTGTCCTACAGTCCTCAGGACTCTACTCCCTCAGCAGCGTGGTGACCGTGCCCTCCAGCAACTTCGGCACCCAGACCTACACCTGCAACGTAGATCACAAGCCCAGCAACACCAAGGTGGACAAGACAGTTGAGCGCAAATGTTGTGTCGAGTGCCCACCGTGCCCAGCACCACCTGTGGCAGGACCGTCAGTCTTCCTCTTCCCCCCAAAACCCAAGGACACCCTCATGATCTCCCGGACCCCTGAGGTCACGTGCGTGGTGGTGGACGTGAGCCACGAAGACCCCGAGGTCCAGTTCAACTGGTACGTGGACGGCGTGGAGGTGCATAATGCCAAGACAAAGCCACGGGAGGAGCAGTTCAACAGCACGTTCCGTGTGGTCAGCGTCCTCACCGTTGTGCACCAGGACTGGCTGAACGGCAAGGAGTACAAGTGCAAGGTCTCCAACAAAGGCCTCCCAGCCCCCATCGAGAAAACCATCTCCAAAACCAAAGGGCAGCCCCGAGAACCACAGGTGTACACCCTGCCCCCATCCCGGGAGGAGATGACCAAGAACCAGGTCAGCCTGACCTGCCTGGTCAAAGGCTTCTACCCCAGCGACATCGCCGTGGAGTGGGAGAGCAATGGGCAGCCGGAGAACAACTACAAGACCACACCTCCCATGCTGGACTCCGACGGCTCCTTCTTCCTCTACAGCAAGCTCACCGTGGACAAGAGCAGGTGGCAGCAGGGGAACGTCTTCTCATGCTCCGTGATGCATGAGGCTCTGCACAACCACTACACGCAGAAGAGCCTCTCCCTGTCTCCGGGTAAA

SEQ ID NO: 356 - protein, 642 aa, Artificial Sequence
  Synthetic: 6G10 (full length wild-type light chain) nucleotide sequence
GCCATCCAGTTGACCCAGTCTCCATCCTCCCTGTCTGCATCTGTAGGAGACAGAGTCACCATCACTTGCCGGGCAAGTCAGGGCATTAGCAGTGCTTTAGCCTGGTATCAGCAGAAACCAGGGAAAGCTCCTAAGCTCCTGATCTATGATGCCTCCAGTTTGGAAAGTGGGGTCCCATCAAGGTTCAGCGGCAGTGGATCTGGGACAGATTTCACTCTCACCATCAGCAGCCTGCAGCCTGAAGATTTTGCAACTTATTACTGTCAACAGTTTAATAGTTACCCGTACACTTTTGGCCAGGGGACCAAGCTGGAGATCAAACGAACTGTGGCTGCACCATCTGTCTTCATCTTCCCGCCATCTGATGAGCAGTTGAAATCTGGAACTGCCTCTGTTGTGTGCCTGCTGAATAACTTCTATCCCAGAGAGGCCAAAGTACAGTGGAAGGTGGATAACGCCCTCCAATCGGGTAACTCCCAGGAGAGTGTCACAGAGCAGGACAGCAAGGACAGCACCTACAGCCTCAGCAGCACCCTGACGCTGAGCAAAGCAGACTACGAGAAACACAAAGTCTACGCCTGCGAAGTCACCCATCAGGGCCTGAGCTCGCCCGTCACAAAGAGCTTCAACAGGGGAGAGTGT

SEQ ID NO: 357 - protein, 141 aa, Artificial Sequence
  Synthetic: 28F3 (VH) (SEQ ID NO: 13) with signal peptide
MRAWIFFLLCLAGRALAQVQLVESGGGVVQPGRSLRLSCAASGFTFSSYGMHWVRQAPGKGLEWVAVIWYEGSNKYYADSVKGRFTISRDNSKNTLYLQMNSLRAEDTAVYYCARGGSMVRGDYYYGMDVWGQGTTVTVSS

SEQ ID NO: 358 - protein, 124 aa, Artificial Sequence
  Synthetic: 28F3 (VL) (SEQ ID NO: 14) with signal peptide
MRAWIFFLLCLAGRALAAIQLTQSPSSLSASVGDRVTITCRASQGISSALAWYQQKPGKAPKLLIYDASSLESGVPSRFSGSGSGTDFTLTISSLQPEDFATYYCQQFNSYPYTFGQGTKLEIK

SEQ ID NO: 359 - DNA, 423 bp, Artificial Sequence
  Synthetic: 28F3 (VH) with signal peptide nucleotide sequence; SEQ ID NO: 147 with sequence encoding signal peptide
atgagggcttggatcttctttctgctctgcctggccgggagagcgctcgcacaggtgcagctggtggagtctgggggaggcgtggtccagcctgggaggtccctgagactctcctgtgcagcgtctggattcaccttcagtagctatggcatgcactgggtccgccaggctccaggcaaggggctggagtgggtggcagttatatggtatgaaggaagtaataaatattatgcagactccgtgaagggccgattcaccatctccagagacaattccaagaacacgctgtatctgcaaatgaacagcctgagagccgaggacacggctgtgtattactgtgcgagaggggggagtatggttcggggggactactactacggtatggacgtctggggccaagggaccacggtcaccgtctcctca

SEQ ID NO: 360 - DNA, 372 bp, Artificial Sequence
  Synthetic: 28F3 (VL) with signal peptide nucleotide sequence; SEQ ID NO: 148 with sequence encoding signal peptide
atgagggcttggatcttctttctgctctgcctggccgggcgcgccttggccgccatccagttgacccagtctccatcctccctgtctgcatctgtaggagacagagtcaccatcacttgccgggcaagtcagggcattagcagtgctttagcctggtatcagcagaaaccagggaaagctcctaagctcctgatctatgatgcctccagtttggaaagtggggtcccatcaaggttcagcggcagtggatctgggacagatttcactctcaccatcagcagcctgcagcctgaagattttgcaacttattactgtcaacagtttaatagttacccgtacacttttggccaggggaccaagctggagatcaaa

SEQ ID NO: 361 - protein, 470 aa, Artificial Sequence
  Synthetic: 28F3.IgG1 (VH + IgG1) (SEQ ID NO: 17) with signal peptide
MRAWIFFLLCLAGRALAQVQLVESGGGVVQPGRSLRLSCAASGFTFSSYGMHWVRQAPGKGLEWVAVIWYEGSNKYYADSVKGRFTISRDNSKNTLYLQMNSLRAEDTAVYYCARGGSMVRGDYYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 362 - protein, 470 aa, Artificial Sequence
  Synthetic: 28F3.IgG1.1 (VH + IgG1.1) (SEQ ID NO: 18) with signal peptide
MRAWIFFLLCLAGRALAQVQLVESGGGVVQPGRSLRLSCAASGFTFSSYGMHWVRQAPGKGLEWVAVIWYEGSNKYYADSVKGRFTISRDNSKNTLYLQMNSLRAEDTAVYYCARGGSMVRGDYYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPSSIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 363 - DNA, 1413 bp, Artificial Sequence
  Synthetic: 28F3.IgG1 (VH + IgG1) with signal peptide nucleotide sequence; SEQ ID NO: 151 with sequence encoding signal peptide
atgagggcttggatcttctttctgctctgcctggccgggagagcgctcgcacaggtgcagctggtggagtctgggggaggcgtggtccagcctgggaggtccctgagactctcctgtgcagcgtctggattcaccttcagtagctatggcatgcactgggtccgccaggctccaggcaaggggctggagtgggtggcagttatatggtatgaaggaagtaataaatattatgcagactccgtgaagggccgattcaccatctccagagacaattccaagaacacgctgtatctgcaaatgaacagcctgagagccgaggacacggctgtgtattactgtgcgagaggggggagtatggttcggggggactactactacggtatggacgtctggggccaagggaccacggtcaccgtctcctcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtccccgggttga

SEQ ID NO: 364 - DNA, 1413 bp, Artificial Sequence
  Synthetic: 28F3.IgG1.1 (VH + IgG1.1) with signal peptide nucleotide sequence; SEQ ID NO: 152 with sequence encoding signal peptide
atgagggcttggatcttctttctgctctgcctggccgggagagcgctcgcacaggtgcagctggtggagtctgggggaggcgtggtccagcctgggaggtccctgagactctcctgtgcagcgtctggattcaccttcagtagctatggcatgcactgggtccgccaggctccaggcaaggggctggagtgggtggcagttatatggtatgaaggaagtaataaatattatgcagactccgtgaagggccgattcaccatctccagagacaattccaagaacacgctgtatctgcaaatgaacagcctgagagccgaggacacggctgtgtattactgtgcgagaggggggagtatggttcggggggactactactacggtatggacgtctggggccaagggaccacggtcaccgtctcctcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaagccgaaggggccccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccaagcagcatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtccccgggttga

SEQ ID NO: 365 - protein, 231 aa, Artificial Sequence
  Synthetic: 28F3.IgG1 (VL+CL) (SEQ ID NO: 19) with signal peptide
MRAWIFFLLCLAGRALAAIQLTQSPSSLSASVGDRVTITCRASQGISSALAWYQQKPGKAPKLLIYDASSLESGVPSRFSGSGSGTDFTLTISSLQPEDFATYYCQQFNSYPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 366 - DNA, 696 bp, Artificial Sequence
  Synthetic: 28F3.IgG1 (VL+CL) with signal peptide nucleotide sequence; SEQ ID NO: 153 with signal sequence
atgagggcttggatcttctttctgctctgcctggccgggcgcgccttggccgccatccagttgacccagtctccatcctccctgtctgcatctgtaggagacagagtcaccatcacttgccgggcaagtcagggcattagcagtgctttagcctggtatcagcagaaaccagggaaagctcctaagctcctgatctatgatgcctccagtttggaaagtggggtcccatcaaggttcagcggcagtggatctgggacagatttcactctcaccatcagcagcctgcagcctgaagattttgcaacttattactgtcaacagtttaatagttacccgtacacttttggccaggggaccaagctggagatcaaacgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttag

SEQ ID NO: 367 - protein, 17 aa, Artificial Sequence
  Synthetic: Signal peptide
MRAWIFFLLCLAGRALA

SEQ ID NO: 368 - DNA, 51 bp, Artificial Sequence
  Synthetic: Signal peptide nucleotide sequence
atgagggcttggatcttctttctgctctgcctggccgggagagcgctcgca

SEQ ID NO: 369 - DNA, 51 bp, Artificial Sequence
  Synthetic: Signal peptide nucleotide sequence
atgagggcttggatcttctttctgctctgcctggccgggcgcgccttggcc

SEQ ID NO: 370 - protein, 31 aa, Homo sapiens
  misc_feature (1)..(31): Human GITR fragment
QRPTGGPGCGPGRLLLGTGTDARCCRVHTTR

SEQ ID NO: 371 - protein, 215 aa, Artificial Sequence; identical to SEQ ID NO: 104
  Synthetic: 9G7 L1 (full length wild-type light chain 1)

SEQ ID NO: 372 - protein, 5 aa, Artificial Sequence
  Synthetic: degenerate VH CDR1
  misc_feature (4)..(4): Xaa can be any naturally occurring amino acid
SYGXH

SEQ ID NO: 373 - protein, 17 aa, Artificial Sequence
  Synthetic: degenerate VH CDR2
  misc_feature (5)..(5): Xaa can be any naturally occurring amino acid
  misc_feature (10)..(10): Xaa can be any naturally occurring amino acid
VIWYXGSNKXYADSVKG

SEQ ID NO: 374 - protein, 17 aa, Artificial Sequence
  Synthetic: degenerate VH CDR2
  misc_feature (5)..(5): Xaa can be any naturally occurring amino acid
  misc_feature (10)..(10): Xaa can be any naturally occurring amino acid
  misc_feature (12)..(12): Xaa can be any naturally occurring amino acid
VIWYXGSNKXYXDSVKG

SEQ ID NO: 375 - protein, 15 aa, Artificial Sequence
  Synthetic: degenerate VH CDR3
  misc_feature (4)..(4): Xaa can be any naturally occurring amino acid
GGSXVRGDYYYGMDV

SEQ ID NO: 376 - protein, 15 aa, Artificial Sequence
  Synthetic: degenerate VH CDR3
  misc_feature (4)..(4): Xaa can be any naturally occurring amino acid
  misc_feature (8)..(8): Xaa can be any naturally occurring amino acid
GGSXVRGXYYYGMDV

SEQ ID NO: 377 - protein, 20 aa, Artificial Sequence
  Synthetic: degenerate VH CDR3
  misc_feature (3)..(9): Xaa can be any naturally occurring amino acid; One Xaa of amino acids 3 - 9 may be absent
  misc_feature (16)..(16): Xaa can be any naturally occurring amino acid
GGXXXXXXXMDVWYYXMDVW

SEQ ID NO: 378 - protein, 11 aa, Artificial Sequence
  Synthetic: degenerate VL CDR1
  misc_feature (9)..(9): Xaa can be any naturally occurring amino acid
RASQGISSXLA

SEQ ID NO: 379 - protein, 12 aa, Artificial Sequence
  Synthetic: degenerate VL CDR1
  misc_feature (6)..(8): Xaa can be any naturally occurring amino acid; One Xaa of amino acids 6 - 8 may be absent
  misc_feature (10)..(10): Xaa can be any naturally occurring amino acid
RASQGXXXSXLA

SEQ ID NO: 380 - protein, 7 aa, Artificial Sequence
  Synthetic: degenerate VL CDR2
  misc_feature (6)..(6): Xaa can be any naturally occurring amino acid
DASSLXS

SEQ ID NO: 381 - protein, 9 aa, Artificial Sequence
  Synthetic: degenerate VL CDR3
  misc_feature (3)..(3): Xaa can be any naturally occurring amino acid
QQXNSYPYT

SEQ ID NO: 382 - protein, 9 aa, Artificial Sequence
  Synthetic: degenerate VL CDR3
  misc_feature (3)..(4): Xaa can be any naturally occurring amino acid
  misc_feature (6)..(6): Xaa can be any naturally occurring amino acid
  misc_feature (8)..(8): Xaa can be any naturally occurring amino acid
QQXXSXPXT

SEQ ID NO: 383 - protein, 330 aa, Artificial Sequence
  Synthetic: IgG1f
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 384 - protein, 326 aa, Artificial Sequence
  Synthetic: IgG2.3
ASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKSCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 385 - protein, 327 aa, Artificial Sequence
  Synthetic: IgG2.3G1-AY
ASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKSCVECPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 386 - protein, 326 aa, Artificial Sequence
  Synthetic: IgG2.3G1-KH
ASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKSCVECPPCPAPPVAGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 387 - protein, 326 aa, Artificial Sequence
  Synthetic: IgG2.5
ASTKGPSVFPLAPSSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 388 - protein, 330 aa, Artificial Sequence
  Synthetic: IgG1.1f
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPSSIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 389 - protein, 326 aa, Artificial Sequence
  Synthetic: IgG2.3G1.1f-KH
ASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKSCVECPPCPAPPVAGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPSSIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 390 - protein, 327 aa, Artificial Sequence
  Synthetic: IgG1-deltaTHT
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 391 - protein, 329 aa, Artificial Sequence
  Synthetic: IgG2.3-plusTHT
ASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKSCVETHTCPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 392 - protein, 329 aa, Artificial Sequence
  Synthetic: IgG2.3-plusGGG
ASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKSCVEGGGCPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 393 - protein, 326 aa, Artificial Sequence
  Synthetic: IgG2.5G1.1f-KH
ASTKGPSVFPLAPSSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPSSIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 394 - protein, 327 aa, Artificial Sequence
  Synthetic: IgG2.5G1-AY
ASTKGPSVFPLAPSSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 395 - protein, 326 aa, Artificial Sequence
  Synthetic: IgG2.5G1-KH
ASTKGPSVFPLAPSSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 396 - protein, 329 aa, Artificial Sequence
  Synthetic: IgG2.5-plusTHT
ASTKGPSVFPLAPSSRSTSESTAALGCLVKDYFPEPVTVSWNSGALTSGVHTFPAVLQSSGLYSLSSVVTVPSSNFGTQTYTCNVDHKPSNTKVDKTVERKCCVETHTCPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 397 - protein, 327 aa, Artificial Sequence
  Synthetic: IgG1-G2.3G1-AY
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVERKSCVECPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 398 - protein, 326 aa, Artificial Sequence
  Synthetic: IgG1-G2.3G1-KH
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVERKSCVECPPCPAPPVAGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 399 - protein, 330 aa, Artificial Sequence
  Synthetic: G2-G1-G1-G1; CH1 domain of IgG2, with all else IgG1
ASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 400 - protein, 330 aa, Artificial Sequence
  Synthetic: G2.5-G1-G1-G1; CH1 domain of IgG2, with all else IgG1
ASTKGPSVFPLAPSSRSTSESTAALGCLVKDYFPEPVTVSWNSGALTSGVHTFPAVLQSSGLYSLSSVVTVPSSNFGTQTYTCNVDHKPSNTKVDKTVERKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 401 - protein, 326 aa, Artificial Sequence
  Synthetic: G1-G2.3-G2-G2; CH1 domain of IgG1 with all else IgG2.3
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 402 - protein, 330 aa, Artificial Sequence
  Synthetic: G1-KRGEGSSNLF; Swap CH1 regions in IgG1 with those of IgG2
ASTKGPSVFPLAPSSRSTSESTAALGCLVKDYFPEPVTVSWNSGALTSGVHTFPAVLQSSGLYSLSSVVTVPSSNFGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 403 - protein, 330 aa, Artificial Sequence
  Synthetic: G1-KRGEGS; Swap CH1 regions in IgG1 with those of IgG2
ASTKGPSVFPLAPSSRSTSESTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 404 - protein, 330 aa, Artificial Sequence
  Synthetic: G1-SNLF; Swap CH1 regions in IgG1 with those of IgG2
ASTKGPSVFPLAPSSKSTSGGTAALGCLVKDYFPEPVTVSWNSGALTSGVHTFPAVLQSSGLYSLSSVVTVPSSNFGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 405 - protein, 330 aa, Artificial Sequence
  Synthetic: IgG1-ITNDRTPR; Swap CH1 regions in IgG1 with those of IgG2
ASTKGPSVFPLAPSSKSTSGGTAALGCLVKDYFPEPVTVSWNSGALTSGVHTFPAVLQSSGLYSLSSVVTVPSSSLGTQTYTCNVDHKPSNTKVDKTVERKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 406 - protein, 329 aa, Artificial Sequence
  Synthetic: G1-SNLFPR; Swap CH1 regions in IgG1 with those of IgG2
ASTKGPSVFPLAPSSKSTSGGTAALGCLVKDYFPEPVTVSWNSGALTSGVHTFPAVLQSSGLYSLSSVVTVPSSNFGTQTYICNVNHKPSNTKVDKRVERKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 407 - protein, 326 aa, Artificial Sequence
  Synthetic: G2-RKEGSGNSFL; Swap CH1 regions in IgG2 with those of IgG1
ASTKGPSVFPLAPCSKSTSGGTAALGCLVKDYFPEPVTVSWNSGALTSGVHTFPAVLQSSGLYSLSSVVTVPSSSLGTQTYTCNVDHKPSNTKVDKTVERKSCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 408 - protein, 326 aa, Artificial Sequence
  Synthetic: G2-RKEGSG; Swap CH1 regions in IgG2 with those of IgG1
ASTKGPSVFPLAPCSKSTSGGTAALGCLVKDYFPEPVTVSWNSGALTSGVHTFPAVLQSSGLYSLSSVVTVPSSNFGTQTYTCNVDHKPSNTKVDKTVERKSCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 409 - protein, 326 aa, Artificial Sequence
  Synthetic: G2-NSFL; Swap CH1 regions in IgG2 with those of IgG1
ASTKGPSVFPLAPCSRSTSESTAALGCLVKDYFPEPVTVSWNSGALTSGVHTFPAVLQSSGLYSLSSVVTVPSSSLGTQTYTCNVDHKPSNTKVDKTVERKSCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 410 - protein, 326 aa, Artificial Sequence
  Synthetic: IgG2-TIDNTRRP; Swap CH1 regions in IgG2 with those of IgG1
ASTKGPSVFPLAPCSRSTSESTAALGCLVKDYFPEPVTVSWNSGALTSGVHTFPAVLQSSGLYSLSSVVTVPSSNFGTQTYICNVNHKPSNTKVDKRVEPKSCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 411 - protein, 326 aa, Artificial Sequence
  Synthetic: G2-NSFLRP; Swap CH1 regions in IgG2 with those of IgG1
ASTKGPSVFPLAPCSRSTSESTAALGCLVKDYFPEPVTVSWNSGALTSGVHTFPAVLQSSGLYSLSSVVTVPSSSLGTQTYTCNVDHKPSNTKVDKTVEPKSCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 412 - protein, 330 aa, Artificial Sequence
  Synthetic: G1-G1-G2-G1-AY; IgG1 with CH2 domain residues of IgG2
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 413 - protein, 329 aa, Artificial Sequence
  Synthetic: G1-G1-G2-G1-KH; IgG1 with CH2 domain residues of IgG2
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 414 - protein, 326 aa, Artificial Sequence
  Synthetic: G2-G2.3-G1-G2-KH; IgG2 with CH2 domain residues of IgG1
ASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKSCVECPPCPAPPVAGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 415 - protein, 326 aa, Artificial Sequence
  Synthetic: G2.5-G2.3-G1-G2-KH; IgG2 with CH2 domain residues of IgG1
ASTKGPSVFPLAPSSRSTSESTAALGCLVKDYFPEPVTVSWNSGALTSGVHTFPAVLQSSGLYSLSSVVTVPSSNFGTQTYTCNVDHKPSNTKVDKTVERKSCVECPPCPAPPVAGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 416 - protein, 326 aa, Artificial Sequence
  Synthetic: G2-G2.3-G1-G2-AY; IgG2 with CH2 domain residues of IgG1
ASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKSCVECPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPG

SEQ ID NO: 417 - protein, 327 aa, Artificial Sequence
  Synthetic: G2.5-G2.3-G1-G2-AY; IgG2 with CH2 domain residues of IgG1
ASTKGPSVFPLAPSSRSTSESTAALGCLVKDYFPEPVTVSWNSGALTSGVHTFPAVLQSSGLYSLSSVVTVPSSNFGTQTYTCNVDHKPSNTKVDKTVERKSCVECPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 418 - protein, 326 aa, Artificial Sequence
  Synthetic: G1-G2.3-G1-G1-KH; Swap hinge regions between IgG1 and IgG2
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCVECPPCPAPPVAGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 419 - protein, 330 aa, Artificial Sequence
  Synthetic: G2-G1-G2-G2-AY; Swap hinge regions between IgG1 and IgG2
ASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKSCDKTHTCPPCPAPELLGGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 420 - protein, 330 aa, Artificial Sequence
  Synthetic: G2.5-G1-G2-G2-AY; Swap hinge regions between IgG1 and IgG2
ASTKGPSVFPLAPSSRSTSESTAALGCLVKDYFPEPVTVSWNSGALTSGVHTFPAVLQSSGLYSLSSVVTVPSSNFGTQTYTCNVDHKPSNTKVDKTVERKSCDKTHTCPPCPAPELLGGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 421 - protein, 327 aa, Artificial Sequence
  Synthetic: G1-G2-G1-G1-AY; Swap hinge regions between IgG1 and IgG2
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCVECPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 422 - protein, 328 aa, Artificial Sequence
  Synthetic: G2-G1-G2-G2-KH; Swap hinge regions between IgG1 and IgG2
ASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKSCDKTHTCPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPG

SEQ ID NO: 423 - protein, 329 aa, Artificial Sequence
  Synthetic: G2.5-G1-G2-G2-KH; Swap hinge regions between IgG1 and IgG2
ASTKGPSVFPLAPSSRSTSESTAALGCLVKDYFPEPVTVSWNSGALTSGVHTFPAVLQSSGLYSLSSVVTVPSSNFGTQTYTCNVDHKPSNTKVDKTVERKSCDKTHTCPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 424 - protein, 323 aa, Artificial Sequence
  Synthetic: IgG1-deltaHinge; Hinge truncation
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 425 - protein, 322 aa, Artificial Sequence
  Synthetic: IgG2-deltaHinge; Hinge truncation
ASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 426 - protein, 322 aa, Artificial Sequence
  Synthetic: IgG2.5-deltaHinge; Hinge truncation
ASTKGPSVFPLAPSSRSTSESTAALGCLVKDYFPEPVTVSWNSGALTSGVHTFPAVLQSSGLYSLSSVVTVPSSNFGTQTYTCNVDHKPSNTKVDKTVERKCPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 427 - protein, 328 aa, Artificial Sequence
  Synthetic: IgG1-deltaG237; Hinge truncation
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 428 - protein, 327 aa, Artificial Sequence
  Synthetic: IgG2-plusG237; Hinge truncation
ASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKSCVECPPCPAPPVAGGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 429 - protein, 326 aa, Artificial Sequence
  Synthetic: IgG2.4
ASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCSVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 430 - protein, 326 aa, Artificial Sequence
  Synthetic: IgG2.3/4
ASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKSSVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 431 - protein, 326 aa, Artificial Sequence
  Synthetic: IgG2.3-V13
ASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKSCVECPPCPAPPVAGDSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 432 - protein, 326 aa, Artificial Sequence
  Synthetic: IgG2.3-V14
ASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKSCVECPPCPAPPVAGDSVFLFPPKPKDTLMISRTPEVTCVVVDVSHEDGEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 433 - protein, 326 aa, Artificial Sequence
  Synthetic: IgG2.3-V15
ASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKSCVECPPCPAPPVAGDSVFLFPPKPKDTLMISRTPEVTCVVVDVSDEDGEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 434 - protein, 326 aa, Artificial Sequence
  Synthetic: IgG2.3-V16
ASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKSCVECPPCPAPPVAGDSVFLFPPKPKDTLMISRTPEVTCVVVDVSHEDGEVQFNWYVDGVEVHNAKTKPREEQFNSTFRVVSVLTVVHQDWLNGKEYKCKVSNKGLPRPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 435 - protein, 326 aa, Artificial Sequence
  Synthetic: IgG2.3-V17
ASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKSCVECPPCPAPPVAGDSVFLFPPKPKDTLMISRTPEVTCVVVDVSDEDGEVQFNWYVDGVEVHNAKTKPREEQFNSTFRVVSVLTVVHQDWLNGKEYKCKVSNKGLPRPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 436 - protein, 326 aa, Artificial Sequence
  Synthetic: IgG2.3-V18
ASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKSCVECPPCPAPPVAGPSVFLFPPKPKDTLMISRTPEVTCVVVDVEHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 437 - protein, 326 aa, Artificial Sequence
  Synthetic: IgG2.3-V19
ASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKSCVECPPCPAPPVAGPSVFLFPPKPKDTLMISRTPEVTCVVVDVEHEDPEVQFNWYVDGVEVHNAKTKPREEQFNSTFRVVSVLTVVHQDWLNGKEYKCKVSNKGFPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 438 - protein, 327 aa, Artificial Sequence
  Synthetic: IgG2.3G1-AY-V20
ASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKSCVECPPCPAPELLGGDSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 439 - protein, 327 aa, Artificial Sequence
  Synthetic: IgG2.3G1-AY-V21
ASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKSCVECPPCPAPELLGGDSVFLFPPKPKDTLMISRTPEVTCVVVDVSHEDGEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 440 - protein, 327 aa, Artificial Sequence
  Synthetic: IgG2.3G1-AY-V22
ASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKSCVECPPCPAPELLGGDSVFLFPPKPKDTLMISRTPEVTCVVVDVSDEDGEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 441 - protein, 327 aa, Artificial Sequence
  Synthetic: IgG2.3G1-AY-V23
ASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKSCVECPPCPAPELLGGDSVFLFPPKPKDTLMISRTPEVTCVVVDVSHEDGEVKFNWYVDGVEVHNAKTKPREEQYNSTYRVVSVLTVLHQDWLNGKEYKCKVSNKALPRPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 442 - protein, 327 aa, Artificial Sequence
  Synthetic: IgG2.3G1-AY-V24
ASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKSCVECPPCPAPELLGGDSVFLFPPKPKDTLMISRTPEVTCVVVDVSDEDGEVKFNWYVDGVEVHNAKTKPREEQYNSTYRVVSVLTVLHQDWLNGKEYKCKVSNKALPRPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 443 - protein, 327 aa, Artificial Sequence
  Synthetic: IgG2.3G1-AY-V25
ASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKSCVECPPCPAPELLGDDSVFLFPPKPKDTLMISRTPEVTCVVVDVSDEDGEVKFNWYVDGVEVHNAKTKPREEQYNSTYRVVSVLTVLHQDWLNGKEYKCKVSNKALPRPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 444 - protein, 327 aa, Artificial Sequence
  Synthetic: IgG2.3G1-AY-V26
ASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKSCVECPPCPAPDLLGDDSVFLFPPKPKDTLMISRTPEVTCVVVDVSDEDGEVKFNWYVDGVEVHNAKTKPREEQYNSTYRVVSVLTVLHQDWLNGKEYKCKVSNKALPRPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 445 - protein, 327 aa, Artificial Sequence
  Synthetic: IgG2.3G1-AY-V27
ASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKSCVECPPCPAPELLGGPSVFLFPPKPKDTLMISRTPEVTCVVVDVEHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 446 - protein, 327 aa, Artificial Sequence
  Synthetic: IgG2.3G1-AY-V28
ASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKSCVECPPCPAPELLGGPSVFLFPPKPKDTLMISRTPEVTCVVVDVEHEDPEVKFNWYVDGVEVHNAKTKPREEQYNSTYRVVSVLTVLHQDWLNGKEYKCKVSNKAFPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 447 - protein, 18 aa, Artificial Sequence
  Synthetic: Alternative hinge
ERKCCVECPPCPAPPVAG

SEQ ID NO: 448 - protein, 18 aa, Artificial Sequence
  Synthetic: Alternative hinge
ERKSCVECPPCPAPPVAG

SEQ ID NO: 449 - protein, 18 aa, Artificial Sequence
  Synthetic: Alternative hinge
ERKCSVECPPCPAPPVAG

SEQ ID NO: 450 - protein, 18 aa, Artificial Sequence
  Synthetic: Alternative hinge
  misc_feature (4)..(4): Xaa can be any naturally occurring amino acid
ERKXCVECPPCPAPPVAG

SEQ ID NO: 451 - protein, 18 aa, Artificial Sequence
  Synthetic: Alternative hinge
  misc_feature (5)..(5): Xaa can be any naturally occurring amino acid
ERKCXVECPPCPAPPVAG

SEQ ID NO: 452 - protein, 19 aa, Artificial Sequence
  Synthetic: Alternative hinge
  misc_feature (19)..(19): Xaa can be any naturally occurring amino acid
ERKCCVECPPCPAPPVAGX

SEQ ID NO: 453 - protein, 19 aa, Artificial Sequence
  Synthetic: Alternative hinge
  misc_feature (19)..(19): Xaa can be any naturally occurring amino acid
ERKSCVECPPCPAPPVAGX

SEQ ID NO: 454 - protein, 19 aa, Artificial Sequence
  Synthetic: Alternative hinge
  misc_feature (19)..(19): Xaa can be any naturally occurring amino acid
ERKCSVECPPCPAPPVAGX

SEQ ID NO: 455 - protein, 19 aa, Artificial Sequence
  Synthetic: Alternative hinge
  misc_feature (4)..(4): Xaa can be any naturally occurring amino acid
  misc_feature (19)..(19): Xaa can be any naturally occurring amino acid
ERKXCVECPPCPAPPVAGX

SEQ ID NO: 456 - protein, 19 aa, Artificial Sequence
  Synthetic: Alternative hinge
  misc_feature (5)..(5): Xaa can be any naturally occurring amino acid
  misc_feature (19)..(19): Xaa can be any naturally occurring amino acid
ERKCXVECPPCPAPPVAGX

SEQ ID NO: 457 - protein, 19 aa, Artificial Sequence
  Synthetic: Alternative hinge
ERKCCVECPPCPAPELLGG

SEQ ID NO: 458 - protein, 19 aa, Artificial Sequence
  Synthetic: Alternative hinge
ERKSCVECPPCPAPELLGG

SEQ ID NO: 459 - protein, 20 aa, Artificial Sequence
  Synthetic: Alternative hinge
ERKCCSVECPPCPAPELLGG

SEQ ID NO: 460 - protein, 19 aa, Artificial Sequence
  Synthetic: Alternative hinge
  misc_feature (4)..(4): Xaa can be any naturally occurring amino acid
ERKXCVECPPCPAPELLGG

SEQ ID NO: 461 - protein, 19 aa, Artificial Sequence
  Synthetic: Alternative hinge
  misc_feature (5)..(5): Xaa can be any naturally occurring amino acid
ERKCXVECPPCPAPELLGG

SEQ ID NO: 462 - protein, 18 aa, Artificial Sequence
  Synthetic: Alternative hinge
ERKCCVECPPCPAPELLG

SEQ ID NO: 463 - protein, 18 aa, Artificial Sequence
  Synthetic: Alternative hinge
ERKSCVECPPCPAPELLG

SEQ ID NO: 464 - protein, 19 aa, Artificial Sequence
  Synthetic: Alternative hinge
ERKCCSVECPPCPAPELLG

SEQ ID NO: 465 - protein, 18 aa, Artificial Sequence
  Synthetic: Alternative hinge
  misc_feature (4)..(4): Xaa can be any naturally occurring amino acid
ERKXCVECPPCPAPELLG

SEQ ID NO: 466 - protein, 18 aa, Artificial Sequence
  Synthetic: Alternative hinge
  misc_feature (5)..(5): Xaa can be any naturally occurring amino acid
ERKCXVECPPCPAPELLG

SEQ ID NO: 467 - protein, 14 aa, Artificial Sequence
  Synthetic: Alternative hinge
ERKCCVECPPCPAP

SEQ ID NO: 468 - protein, 14 aa, Artificial Sequence
  Synthetic: Alternative hinge
ERKSCVECPPCPAP

SEQ ID NO: 469 - protein, 14 aa, Artificial Sequence
  Synthetic: Alternative hinge
ERKCSVECPPCPAP

SEQ ID NO: 470 - protein, 14 aa, Artificial Sequence
  Synthetic: Alternative hinge
  misc_feature (4)..(4): Xaa can be any naturally occurring amino acid
ERKXCVECPPCPAP

SEQ ID NO: 471 - protein, 14 aa, Artificial Sequence
  Synthetic: Alternative hinge
  misc_feature (5)..(5): Xaa can be any naturally occurring amino acid
ERKCXVECPPCPAP

SEQ ID NO: 472 - protein, 4 aa, Artificial Sequence
  Synthetic: Portion of hinge
PVAG

SEQ ID NO: 473 - protein, 4 aa, Artificial Sequence
  Synthetic: Portion of hinge
ELLG

SEQ ID NO: 474 - protein, 5 aa, Artificial Sequence
  Synthetic: Portion of hinge
ELLGG

SEQ ID NO: 475 - protein, 7 aa, Artificial Sequence
  Synthetic: Portion of hinge
SCDKTHT

SEQ ID NO: 476 - protein, 4 aa, Artificial Sequence
  Synthetic: Portion of hinge
CCVE

SEQ ID NO: 477 - protein, 98 aa, Artificial Sequence; identical to SEQ ID NO: 279
  Synthetic: wt IgG2 CH1 domain

SEQ ID NO: 478 - protein, 116 aa, Artificial Sequence
  Synthetic: IgG2 CH1 and hinge
ASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAG

SEQ ID NO: 479 - protein, 7 aa, Artificial Sequence
  Synthetic: Portion of hinge
CPPCPAP

SEQ ID NO: 480 - protein, 327 aa, Artificial Sequence
  Synthetic: IgG2.3G1-AY-V9-D270E
ASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKSCVECPPCPAPELLGDDSVFLFPPKPKDTLMISRTPEVTCVVVDVSHEEGEVKFNWYVDGVEVHNAKTKPREEQYNSTYRVVSVLTVLHQDWLNGKEYKCKVSNKALPRPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 481 - protein, 327 aa, Artificial Sequence; identical to SEQ ID NO: 443
  Synthetic: IgG2.3G1-AY-V11

SEQ ID NO: 482 - protein, 327 aa, Artificial Sequence
  Synthetic: IgG2.5G1-AY-V9-D270E
ASTKGPSVFPLAPSSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPELLGDDSVFLFPPKPKDTLMISRTPEVTCVVVDVSHEEGEVKFNWYVDGVEVHNAKTKPREEQYNSTYRVVSVLTVLHQDWLNGKEYKCKVSNKALPRPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 483 - protein, 327 aa, Artificial Sequence
  Synthetic: IgG2.5G1-AY-V11
ASTKGPSVFPLAPSSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPELLGDDSVFLFPPKPKDTLMISRTPEVTCVVVDVSDEDGEVKFNWYVDGVEVHNAKTKPREEQYNSTYRVVSVLTVLHQDWLNGKEYKCKVSNKALPRPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 484 - protein, 330 aa, Artificial Sequence
  Synthetic: IgG1f-GASDALIE
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLAGPDVFLFPPKPKDTLMISRTPEVTCVVVDVSHEDPEVKFNWYVDGVEVHNAKTKPREEQYNSTYRVVSVLTVLHQDWLNGKEYKCKVSNKALPLPEEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 485 - protein, 330 aa, Artificial Sequence
  Synthetic: IgG1f-G236A
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLAGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 486 - protein, 327 aa, Artificial Sequence
  Synthetic: IgG2.3G1-AY-G236A
ASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKSCVECPPCPAPELLAGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 487 - protein, 327 aa, Artificial Sequence
  Synthetic: IgG2.3G1-AY-GASDALIE
ASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKSCVECPPCPAPELLAGPDVFLFPPKPKDTLMISRTPEVTCVVVDVSHEDPEVKFNWYVDGVEVHNAKTKPREEQYNSTYRVVSVLTVLHQDWLNGKEYKCKVSNKALPLPEEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 488 - protein, 327 aa, Artificial Sequence
  Synthetic: IgG2.5G1-AY-G236A
ASTKGPSVFPLAPSSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPELLAGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 489 - protein, 326 aa, Artificial Sequence
  Synthetic: IgG2.5G1-AY-GASDALIE
STKGPSVFPLAPSSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPELLAGPDVFLFPPKPKDTLMISRTPEVTCVVVDVSHEDPEVKFNWYVDGVEVHNAKTKPREEQYNSTYRVVSVLTVLHQDWLNGKEYKCKVSNKALPLPEEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 490 - protein, 327 aa, Artificial Sequence
  Synthetic: IgG2.3G1.1f-AY
ASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKSCVECPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPSSIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 491 - protein, 327 aa, Artificial Sequence
  Synthetic: IgG2.3G1.3f-AY
ASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKSCVECPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 492 - protein, 327 aa, Artificial Sequence
  Synthetic: IgG2.3G1-AY-D265A
ASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKSCVECPPCPAPELLGGPSVFLFPPKPKDTLMISRTPEVTCVVVAVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 493 - protein, 327 aa, Artificial Sequence
  Synthetic: IgG2.3G1-AY-N297A
ASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKSCVECPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 494 - protein, 327 aa, Artificial Sequence
  Synthetic: IgG2.5G1.1f-AY
ASTKGPSVFPLAPSSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPSSIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 495 - protein, 327 aa, Artificial Sequence
  Synthetic: IgG2.5G1.3f-AY
ASTKGPSVFPLAPSSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 496 - protein, 327 aa, Artificial Sequence
  Synthetic: IgG2.5G1-AY-D265A
ASTKGPSVFPLAPSSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPELLGGPSVFLFPPKPKDTLMISRTPEVTCVVVAVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 497 - protein, 327 aa, Artificial Sequence
  Synthetic: IgG2.5G1-AY-N297A
ASTKGPSVFPLAPSSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 498 - protein, 330 aa, Artificial Sequence
  Synthetic: CT
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTSPPSPAPELLGGSSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 499 - protein, 330 aa, Artificial Sequence
  Synthetic: CTf
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTSPPSPAPELLGGSSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 500 - protein, 327 aa, Artificial Sequence
  Synthetic: IgG2.3-CT
ASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKSCVESPPSPAPELLGGSSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 501 - protein, 327 aa, Artificial Sequence
  Synthetic: IgG2.5-CT
ASTKGPSVFPLAPSSRSTSESTAALGCLVKDYFPEPVTVSWNSGALTSGVHTFPAVLQSSGLYSLSSVVTVPSSNFGTQTYTCNVDHKPSNTKVDKTVERKCCVESPPSPAPELLGGSSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 502 - protein, 330 aa, Artificial Sequence
  Synthetic: IgG1fa-C226S
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTSPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 503 - protein, 330 aa, Artificial Sequence
  Synthetic: IgG1fa-C229S
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPSPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 504 - protein, 330 aa, Artificial Sequence
  Synthetic: IgG1fa-C226S,C229S
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTSPPSPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 505 - protein, 330 aa, Artificial Sequence
  Synthetic: IgG1fa-P238S
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGSSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 506 - protein, 330 aa, Artificial Sequence
  Synthetic: IgG1fa-C226A
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTAPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 507 - protein, 330 aa, Artificial Sequence
  Synthetic: IgG1fa-C229A
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPAPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 508 - protein, 330 aa, Artificial Sequence
  Synthetic: IgG1fa-C226A,C229A
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTAPPAPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 509 - protein, 330 aa, Artificial Sequence
  Synthetic: IgG1fa-P238K
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGKSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 510 - protein, 326 aa, Artificial Sequence
  Synthetic: IgG2.3-R133K
ASTKGPSVFPLAPCSKSTSESTAALGCLVKDYFPEPVTVSWNSGALTSGVHTFPAVLQSSGLYSLSSVVTVPSSNFGTQTYTCNVDHKPSNTKVDKTVERKSCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 511 - protein, 326 aa, Artificial Sequence
  Synthetic: IgG2.3-E137G
ASTKGPSVFPLAPCSRSTSGSTAALGCLVKDYFPEPVTVSWNSGALTSGVHTFPAVLQSSGLYSLSSVVTVPSSNFGTQTYTCNVDHKPSNTKVDKTVERKSCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 512 - protein, 326 aa, Artificial Sequence
  Synthetic: IgG2.3-S138G
ASTKGPSVFPLAPCSRSTSEGTAALGCLVKDYFPEPVTVSWNSGALTSGVHTFPAVLQSSGLYSLSSVVTVPSSNFGTQTYTCNVDHKPSNTKVDKTVERKSCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 513 - protein, 326 aa, Artificial Sequence
  Synthetic: IgG2.3-E137G-S138G
ASTKGPSVFPLAPCSRSTSGGTAALGCLVKDYFPEPVTVSWNSGALTSGVHTFPAVLQSSGLYSLSSVVTVPSSNFGTQTYTCNVDHKPSNTKVDKTVERKSCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 514 - protein, 326 aa, Artificial Sequence
  Synthetic: IgG2.3-T214R
ASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKRVERKSCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 515 - protein, 326 aa, Artificial Sequence
  Synthetic: IgG2.3-R217P
ASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVEPKSCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 516 - protein, 326 aa, Artificial Sequence
  Synthetic: IgG2.3-R217S
ASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVESKSCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 517 - protein, 326 aa, Artificial Sequence
  Synthetic: IgG2.3-V224A
ASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKSCAECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 518 - protein, 326 aa, Artificial Sequence
  Synthetic: IgG2.3-E225A
ASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKSCVACPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 519 - protein, 326 aa, Artificial Sequence
  Synthetic: IgG2.3-R133A
ASTKGPSVFPLAPCSASTSESTAALGCLVKDYFPEPVTVSWNSGALTSGVHTFPAVLQSSGLYSLSSVVTVPSSNFGTQTYTCNVDHKPSNTKVDKTVERKSCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 520 - protein, 326 aa, Artificial Sequence
  Synthetic: IgG2.3-E137D
ASTKGPSVFPLAPCSRSTSDSTAALGCLVKDYFPEPVTVSWNSGALTSGVHTFPAVLQSSGLYSLSSVVTVPSSNFGTQTYTCNVDHKPSNTKVDKTVERKSCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 521 - protein, 326 aa, Artificial Sequence
  Synthetic: IgG2.3-E137Q
ASTKGPSVFPLAPCSRSTSQSTAALGCLVKDYFPEPVTVSWNSGALTSGVHTFPAVLQSSGLYSLSSVVTVPSSNFGTQTYTCNVDHKPSNTKVDKTVERKSCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 522 - protein, 326 aa, Artificial Sequence
  Synthetic: IgG2.3-S138T
ASTKGPSVFPLAPCSRSTSETTAALGCLVKDYFPEPVTVSWNSGALTSGVHTFPAVLQSSGLYSLSSVVTVPSSNFGTQTYTCNVDHKPSNTKVDKTVERKSCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 523 - protein, 326 aa, Artificial Sequence
  Synthetic: IgG2.3-S138E
ASTKGPSVFPLAPCSRSTSEETAALGCLVKDYFPEPVTVSWNSGALTSGVHTFPAVLQSSGLYSLSSVVTVPSSNFGTQTYTCNVDHKPSNTKVDKTVERKSCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 524 - protein, 326 aa, Artificial Sequence
  Synthetic: IgG2.3-E137A-S138I
ASTKGPSVFPLAPCSRSTSAITAALGCLVKDYFPEPVTVSWNSGALTSGVHTFPAVLQSSGLYSLSSVVTVPSSNFGTQTYTCNVDHKPSNTKVDKTVERKSCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 525 - protein, 326 aa, Artificial Sequence
  Synthetic: IgG2.3-E137I-S138A
ASTKGPSVFPLAPCSRSTSIATAALGCLVKDYFPEPVTVSWNSGALTSGVHTFPAVLQSSGLYSLSSVVTVPSSNFGTQTYTCNVDHKPSNTKVDKTVERKSCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 526 - protein, 326 aa, Artificial Sequence
  Synthetic: IgG2.3-R217G
ASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVEGKSCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 527 - protein, 326 aa, Artificial Sequence
  Synthetic: IgG2.3-R217A
ASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVEAKSCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 528 - protein, 326 aa, Artificial Sequence
  Synthetic: IgG2.3-R217I
ASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVEIKSCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 529 - protein, 326 aa, Artificial Sequence
  Synthetic: IgG2.3-R217E
ASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVEEKSCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 530 - protein, 326 aa, Artificial Sequence
  Synthetic: IgG2.3-R217K
ASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVEKKSCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 531 - protein, 326 aa, Artificial Sequence
  Synthetic: IgG2.3-V224I
ASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKSCIECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 532 - protein, 326 aa, Artificial Sequence
  Synthetic: IgG2.3-E225D
ASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKSCVDCPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 533 - protein, 327 aa, Artificial Sequence
  Synthetic: IgG2-G4.1-G4-G4
ASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 534 - protein, 326 aa, Artificial Sequence
  Synthetic: IgG4-G2.3-G2-G2
ASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKSCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 535 - protein, 327 aa, Artificial Sequence
  Synthetic: IgG2-G4.1-G2-G2
ASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKYGPPCPPCPAPEFLGGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 536 - protein, 326 aa, Artificial Sequence
  Synthetic: IgG4-G2.3-G4-G4
ASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKSCVECPPCPAPPVAGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 537 - protein, 326 aa, Artificial Sequence
  Synthetic: IgG2-G2.3-G4-G4
ASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKSCVECPPCPAPPVAGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 538 - protein, 327 aa, Artificial Sequence
  Synthetic: IgG4-G4.1-G2-G2
ASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 539 - protein, 327 aa, Artificial Sequence
  Synthetic: IgG4-G4.1-G1-G1
ASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 540 - protein, 327 aa, Artificial Sequence
  Synthetic: IgG4.1
ASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 541 - protein, 327 aa, Artificial Sequence
  Synthetic: IgG4.1-R214T
ASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKTVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 542 - protein, 327 aa, Artificial Sequence
  Synthetic: IgG4.1-S217R
ASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVERKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 543 - protein, 327 aa, Artificial Sequence
  Synthetic: IgG4.1-S217P
ASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVEPKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

We claim:

1. An antibody that binds to human glucocorticoid-inducible TNF receptor (GITR), wherein the antibody comprises (a) heavy chain CDR1, CDR2, and CDR3 sequences comprising SEQ ID NOs: 20, 21, and 22, respectively, and light chain CDR1, CDR2, and CDR3 sequences comprising SEQ ID NOs: 23, 24, and 25, respectively, and (b) a heavy chain constant region comprising (i) the amino acid sequence of SEQ ID NO: 394 or (ii) an amino acid sequence identical to SEQ ID NO: 394, except wherein the Ser at position 267 is Glu.

2. The antibody of claim 1, which comprises heavy and light chain variable regions comprising the amino acid sequences set forth in SEQ ID NOs: 13 and 14, respectively.

3. The antibody of claim 1, wherein the antibody comprises a heavy chain comprising a variable region comprising the amino acid sequence set forth in SEQ ID NO: 13 and a constant region comprising the amino acid sequence set forth in SEQ ID NO: 394, and a light chain comprising the amino acid sequence set forth in SEQ ID NO: 19.

4. The antibody of claim 1, wherein the antibody is a human or humanized antibody.

5. A bispecific molecule comprising the antibody of claim 1 linked to a molecule having a second binding specificity.

6. A nucleic acid encoding a heavy and/or light chain variable region of the antibody of claim 1.

7. An expression vector comprising the nucleic acid of claim 6.

8. A cell transformed with an expression vector of claim 7.

9. An immunoconjugate comprising the antibody of claim 1, linked to an agent.

10. A composition comprising the antibody of claim 1, and a carrier.

11. A kit comprising the antibody of claim 1, and instructions for use.

12. A method of stimulating a T cell-mediated immune response in a subject comprising administering the antibody of claim 1 to the subject such that a T cell-mediated immune response in the subject is stimulated.

13. A method of stimulating a T cell-mediated immune response in a subject comprising administering the antibody of claim 2 to the subject such that a T cell-mediated immune response in the subject is stimulated.

14. A method of stimulating a T cell-mediated immune response in a subject comprising administering the antibody of claim 3 to the subject such that a T cell-mediated immune response in the subject is stimulated.

* * * * *